United States Patent
Chen et al.

(10) Patent No.: US 12,037,583 B2
(45) Date of Patent: Jul. 16, 2024

(54) COMPOSITIONS AND METHODS FOR IMMUNOONCOLOGY

(71) Applicants: Novartis AG, Basel (CH); Intellia Therapeutics, Inc., Cambridge, MA (US)

(72) Inventors: Ming-Wei Chen, Winchester, MA (US); Melissa Deck, Acton, MA (US); Glenn Dranoff, Lexington, MA (US); Craig Stephen Mickanin, Hopkinton, MA (US); Reynald Lescarbeau, Dracut, MA (US); Celeste Richardson, Brookline, MA (US); Morag Helen Stewart, Boston, MA (US); Yi Yang, Belmont, MA (US)

(73) Assignees: Novartis AG, Basel (CH); Intellia Therapeutics, Inc., Cambridge, MA (US)

( * ) Notice: Subject to any disclaimer, the term of this patent is extended or adjusted under 35 U.S.C. 154(b) by 980 days.

(21) Appl. No.: 15/780,751

(22) PCT Filed: Dec. 2, 2016

(86) PCT No.: PCT/IB2016/057318
§ 371 (c)(1),
(2) Date: Jun. 1, 2018

(87) PCT Pub. No.: WO2017/093969
PCT Pub. Date: Jun. 8, 2017

(65) Prior Publication Data
US 2018/0362975 A1    Dec. 20, 2018

Related U.S. Application Data

(60) Provisional application No. 62/394,290, filed on Sep. 14, 2016, provisional application No. 62/316,784, filed on Apr. 1, 2016, provisional application No. 62/263,169, filed on Dec. 4, 2015.

(51) Int. Cl.
| | |
|---|---|
| *C12N 15/113* | (2010.01) |
| *A61K 9/00* | (2006.01) |
| *A61K 31/7088* | (2006.01) |
| *A61K 35/17* | (2015.01) |
| *A61K 38/17* | (2006.01) |
| *A61K 38/46* | (2006.01) |
| *A61K 45/06* | (2006.01) |
| *C12N 15/09* | (2006.01) |
| *C12N 15/10* | (2006.01) |

(52) U.S. Cl.
CPC .......... *C12N 15/113* (2013.01); *A61K 9/0009* (2013.01); *A61K 31/7088* (2013.01); *A61K 35/17* (2013.01); *A61K 38/177* (2013.01); *A61K 38/1774* (2013.01); *A61K 38/465* (2013.01); *A61K 45/06* (2013.01); *C12N 15/09* (2013.01); *C12N 15/102* (2013.01); *C12N 15/1135* (2013.01); *C12N 15/1138* (2013.01); *C12N 2310/10* (2013.01); *C12N 2310/20* (2017.05); *C12N 2310/315* (2013.01); *C12N 2310/321* (2013.01); *C12N 2320/32* (2013.01); *C12N 2320/35* (2013.01); *C12N 2510/00* (2013.01); *Y02A 50/30* (2018.01)

(58) Field of Classification Search
None
See application file for complete search history.

(56) References Cited

U.S. PATENT DOCUMENTS

| | | |
|---|---|---|
| 5,359,046 A | 10/1994 | Capon et al. |
| 5,686,281 A | 11/1997 | Roberts |
| 5,712,149 A | 1/1998 | Roberts |
| 5,874,240 A | 2/1999 | Ni et al. |
| 5,906,936 A | 5/1999 | Eshhar et al. |
| 6,103,521 A | 8/2000 | Capon et al. |
| 6,319,494 B1 | 11/2001 | Capon et al. |
| 6,355,779 B1 | 3/2002 | Goodwin et al. |
| 6,410,319 B1 | 6/2002 | Raubitschek et al. |
| 6,475,481 B2 | 11/2002 | Talmadge |
| 6,569,997 B1 | 5/2003 | Kwon |
| 7,049,136 B2 | 5/2006 | Seed et al. |
| 7,052,906 B1 | 5/2006 | Lawson et al. |
| 7,070,995 B2 | 7/2006 | Jensen |
| 7,265,209 B2 | 9/2007 | Jensen |
| 7,319,143 B2 | 1/2008 | Gross et al. |
| 7,320,787 B2 | 1/2008 | Seed et al. |
| 7,446,190 B2 | 11/2008 | Sadelain et al. |
| 7,446,191 B2 | 11/2008 | Jensen |
| 7,514,537 B2 | 4/2009 | Jensen |
| 7,638,326 B2 | 12/2009 | June et al. |
| 7,741,465 B1 | 6/2010 | Eshhar et al. |
| 7,745,140 B2 | 6/2010 | June et al. |

(Continued)

FOREIGN PATENT DOCUMENTS

| | | |
|---|---|---|
| CN | 104611370 A | 5/2015 |
| CN | 105051188 A | 11/2015 |

(Continued)

OTHER PUBLICATIONS

Sato T, Akatsuka H, Yamaguchi Y, Miyashita K, Tanaka M, et al. (2015) Establishment of β-2 microglobulin deficient human iPS cells using CRISPR/Cas9 system. Integr Mol Med 2: (Year: 2015).*

Sato T, Akatsuka H, Yamaguchi Y, Miyashita K, Tanaka M, et al. (2015) Establishment of β-2 microglobulin deficient human iPS cells using CRISPR/Cas9 system. Integr Mol Med 2015;2(6):373-7. Cited in prior action. (Year: 2015).*

(Continued)

*Primary Examiner* — Robert M Kelly
(74) *Attorney, Agent, or Firm* — Finnegan, Henderson, Farabow, Garrett & Dunner, LLP

(57) ABSTRACT

The present invention is directed to genome editing systems, reagents and methods for immunooncology.

55 Claims, 85 Drawing Sheets
Specification includes a Sequence Listing.

(56) References Cited

U.S. PATENT DOCUMENTS

| | | |
|---|---|---|
| 7,754,482 B2 | 7/2010 | Riley et al. |
| 7,994,298 B2 | 8/2011 | Zhang et al. |
| 8,211,422 B2 | 7/2012 | Eshhar et al. |
| 8,252,914 B2 | 8/2012 | Zhang et al. |
| 8,389,282 B2 | 3/2013 | Sadelain et al. |
| 8,399,645 B2 | 3/2013 | Campana et al. |
| 8,465,743 B2 | 6/2013 | Rosenberg et al. |
| 8,637,307 B2 | 1/2014 | June et al. |
| 8,722,400 B2 | 5/2014 | Riley et al. |
| 8,906,682 B2 | 12/2014 | June et al. |
| 8,911,993 B2 | 12/2014 | June et al. |
| 8,916,381 B1 | 12/2014 | June et al. |
| 8,975,071 B1 | 3/2015 | June et al. |
| 9,101,584 B2 | 8/2015 | June et al. |
| 9,102,760 B2 | 8/2015 | June et al. |
| 9,102,761 B2 | 8/2015 | June et al. |
| 9,272,002 B2 | 3/2016 | Powell, Jr. et al. |
| 9,328,156 B2 | 5/2016 | June et al. |
| 9,365,641 B2 | 6/2016 | June et al. |
| 9,394,368 B2 | 7/2016 | Brogdon et al. |
| 9,402,865 B2 | 8/2016 | Powell et al. |
| 9,422,351 B2 | 8/2016 | Scholler et al. |
| 9,446,105 B2 | 9/2016 | Powell, Jr. |
| 9,464,140 B2 | 10/2016 | June et al. |
| 9,481,728 B2 | 11/2016 | June et al. |
| 9,499,629 B2 | 11/2016 | June et al. |
| 9,518,123 B2 | 12/2016 | June et al. |
| 9,540,445 B2 | 1/2017 | June et al. |
| 9,572,836 B2 | 2/2017 | June et al. |
| 9,573,988 B2 | 2/2017 | Brogdon et al. |
| 9,598,489 B2 | 3/2017 | Powell, Jr. |
| 9,708,384 B2 | 7/2017 | Scholler et al. |
| 9,714,278 B2 | 7/2017 | June et al. |
| 9,745,368 B2 | 8/2017 | Milone et al. |
| 9,765,156 B2 | 9/2017 | June et al. |
| 9,777,061 B2 | 10/2017 | Ebersbach et al. |
| 9,815,901 B2 | 11/2017 | Brogdon et al. |
| 9,999,671 B2 | 6/2018 | Liu et al. |
| 10,689,438 B2 | 6/2020 | Zhang et al. |
| 2003/0060444 A1 | 3/2003 | Finney et al. |
| 2003/0077249 A1 | 4/2003 | Bebbington et al. |
| 2003/0105000 A1 | 6/2003 | Pero et al. |
| 2003/0148982 A1 | 8/2003 | Brenner et al. |
| 2003/0224520 A1 | 12/2003 | June et al. |
| 2004/0038886 A1 | 2/2004 | Finney et al. |
| 2004/0043401 A1 | 3/2004 | Sadelain et al. |
| 2005/0113564 A1 | 5/2005 | Campana et al. |
| 2005/0129671 A1 | 6/2005 | Cooper et al. |
| 2007/0036773 A1 | 2/2007 | Cooper et al. |
| 2008/0131415 A1 | 6/2008 | Riddell et al. |
| 2008/0160090 A1 | 7/2008 | Oraevsky et al. |
| 2008/0254513 A1 | 10/2008 | Cayli |
| 2009/0257994 A1 | 10/2009 | Jensen |
| 2011/0052554 A1 | 3/2011 | Zakrzewski et al. |
| 2011/0158957 A1 | 6/2011 | Bonini et al. |
| 2012/0027802 A1 | 2/2012 | Bonini et al. |
| 2012/0148552 A1 | 6/2012 | Jensen |
| 2012/0302466 A1 | 11/2012 | Sentman |
| 2012/0321667 A1 | 12/2012 | Sentman |
| 2013/0071409 A1 | 3/2013 | Riley et al. |
| 2013/0071414 A1 | 3/2013 | Dotti et al. |
| 2013/0149337 A1 | 6/2013 | Cooper et al. |
| 2013/0155909 A1 | 6/2013 | Jackson et al. |
| 2013/0287748 A1 | 10/2013 | June et al. |
| 2014/0050708 A1 | 2/2014 | Powell et al. |
| 2014/0099309 A1 | 4/2014 | Powell, Jr. et al. |
| 2014/0099340 A1 | 4/2014 | June et al. |
| 2014/0106449 A1 | 4/2014 | June et al. |
| 2014/0186947 A1 | 7/2014 | June et al. |
| 2014/0212446 A1 | 7/2014 | Riley et al. |
| 2014/0219975 A1 | 8/2014 | June et al. |
| 2014/0227237 A1 | 8/2014 | June et al. |
| 2014/0271635 A1 | 9/2014 | Brogdon et al. |
| 2014/0273226 A1* | 9/2014 | Wu .................. C12N 15/102 435/455 |
| 2014/0322169 A1 | 10/2014 | Harper et al. |
| 2014/0322183 A1 | 10/2014 | Milone et al. |
| 2014/0322212 A1 | 10/2014 | Brogdon et al. |
| 2014/0322275 A1 | 10/2014 | Brogdon et al. |
| 2014/0349402 A1 | 11/2014 | Cooper et al. |
| 2014/0370045 A1 | 12/2014 | June et al. |
| 2015/0017136 A1 | 1/2015 | Galetto et al. |
| 2015/0017141 A1 | 1/2015 | June et al. |
| 2015/0140019 A1 | 5/2015 | June et al. |
| 2015/0190428 A1 | 7/2015 | June et al. |
| 2015/0202286 A1 | 7/2015 | June et al. |
| 2015/0283178 A1 | 10/2015 | June et al. |
| 2015/0290244 A1 | 10/2015 | June et al. |
| 2015/0342994 A1 | 12/2015 | Riley et al. |
| 2016/0046724 A1 | 2/2016 | Brogdon et al. |
| 2016/0051651 A1 | 2/2016 | Brogdon et al. |
| 2016/0068601 A1 | 3/2016 | Brogdon et al. |
| 2016/0096892 A1 | 4/2016 | Brogdon et al. |
| 2016/0185861 A1 | 6/2016 | Bedoya et al. |
| 2016/0186208 A1 | 6/2016 | Jaenisch et al. |
| 2016/0311907 A1 | 10/2016 | Brogdon et al. |
| 2016/0311917 A1 | 10/2016 | Beatty et al. |
| 2016/0340406 A1 | 11/2016 | Zhao et al. |
| 2016/0348073 A1* | 12/2016 | Meissner .............. C12N 5/0636 |
| 2016/0362472 A1 | 12/2016 | Bitter et al. |
| 2017/0008963 A1 | 1/2017 | Brogdon et al. |
| 2017/0081411 A1 | 3/2017 | Engels et al. |
| 2017/0137783 A1 | 5/2017 | Bedoya et al. |
| 2017/0183415 A1 | 6/2017 | Brogdon et al. |
| 2017/0209492 A1 | 7/2017 | June et al. |
| 2017/0211055 A1 | 7/2017 | Brogdon et al. |
| 2017/0226495 A1 | 8/2017 | Guimaraes |
| 2017/0239294 A1 | 8/2017 | Thomas-Tikhonenko et al. |
| 2017/0260268 A1 | 9/2017 | Beatty et al. |
| 2017/0274014 A1 | 9/2017 | Brogdon et al. |
| 2017/0306416 A1 | 10/2017 | Bedoya et al. |
| 2017/0335281 A1 | 11/2017 | Loew et al. |
| 2018/0022795 A1 | 1/2018 | Milone et al. |
| 2018/0044423 A1 | 2/2018 | Ebersbach et al. |
| 2018/0044424 A1 | 2/2018 | June et al. |
| 2018/0118834 A1 | 5/2018 | Brogdon et al. |
| 2018/0125892 A1 | 5/2018 | Brannetti et al. |
| 2018/0133296 A1 | 5/2018 | Barrett et al. |
| 2018/0140602 A1 | 5/2018 | Angst et al. |
| 2018/0230193 A1 | 8/2018 | Loew et al. |
| 2018/0252727 A1 | 9/2018 | Garfall et al. |
| 2018/0258149 A1 | 9/2018 | Motz et al. |
| 2018/0298068 A1 | 10/2018 | Albelda |
| 2018/0312595 A1 | 11/2018 | Brogdon et al. |
| 2018/0344738 A1 | 12/2018 | Behnke et al. |
| 2019/0000880 A1 | 1/2019 | Motz et al. |
| 2019/0000944 A1 | 1/2019 | Brogdon et al. |
| 2019/0135940 A1 | 5/2019 | Brogdon et al. |
| 2019/0151365 A1 | 5/2019 | Anak et al. |
| 2019/0153061 A1 | 5/2019 | Brogdon et al. |
| 2019/0161542 A1 | 5/2019 | Gill et al. |
| 2019/0263914 A1 | 8/2019 | Brogdon et al. |
| 2019/0269727 A1 | 9/2019 | Fachin et al. |
| 2019/0292238 A1 | 9/2019 | Bitter et al. |
| 2019/0292257 A1 | 9/2019 | Bedoya et al. |
| 2019/0298715 A1 | 10/2019 | Motz et al. |
| 2019/0330356 A1 | 10/2019 | Brogdon et al. |
| 2019/0336504 A1 | 11/2019 | Gill et al. |
| 2019/0375815 A1 | 12/2019 | Engels et al. |
| 2019/0382500 A1 | 12/2019 | Abujoub et al. |
| 2019/0388471 A1 | 12/2019 | June et al. |
| 2019/0389928 A1 | 12/2019 | Posey et al. |
| 2020/0048359 A1 | 2/2020 | Albelda et al. |
| 2020/0055948 A1 | 2/2020 | Daley et al. |
| 2020/0061113 A1 | 2/2020 | Kassim et al. |
| 2020/0087376 A1 | 3/2020 | Fraietta et al. |
| 2020/0131474 A1 | 4/2020 | Berenshteyn et al. |
| 2021/0017266 A1 | 1/2021 | Racine et al. |
| 2021/0071182 A1 | 3/2021 | Brogdon et al. |

FOREIGN PATENT DOCUMENTS

| | | |
|---|---|---|
| CN | 105158466 A | 12/2015 |
| EP | 0574512 A1 | 12/1993 |

(56) References Cited

FOREIGN PATENT DOCUMENTS

| | | |
|---|---|---|
| EP | 0871495 A1 | 10/1998 |
| EP | 1226244 A2 | 7/2002 |
| EP | 1955708 A1 | 8/2008 |
| JP | 2016501531 A | 1/2016 |
| RU | 2560701 | 8/2015 |
| WO | WO 1992/015322 A1 | 9/1992 |
| WO | WO 1995/007268 A1 | 3/1995 |
| WO | WO 1995/030014 A1 | 11/1995 |
| WO | WO 1996/023814 A1 | 8/1996 |
| WO | WO 1996/024671 A1 | 8/1996 |
| WO | WO 1997/015669 A1 | 5/1997 |
| WO | WO 1997/023613 A2 | 7/1997 |
| WO | WO 1998/018809 A1 | 5/1998 |
| WO | WO 1999/000494 A2 | 1/1999 |
| WO | WO 2000/014257 A1 | 3/2000 |
| WO | WO 2002/033101 A1 | 4/2002 |
| WO | WO 2002/077029 A2 | 10/2002 |
| WO | WO 2002/088334 A1 | 11/2002 |
| WO | WO 2003/057171 A2 | 7/2003 |
| WO | WO 2005/019429 A2 | 3/2005 |
| WO | WO 2005/044996 A2 | 5/2005 |
| WO | WO 2005/118788 A2 | 12/2005 |
| WO | WO 2006/060878 A1 | 6/2006 |
| WO | WO 2008/045437 A2 | 4/2008 |
| WO | WO 2009/150229 A1 | 12/2009 |
| WO | WO 2010/085660 A2 | 7/2010 |
| WO | WO 2010/129469 A1 | 11/2010 |
| WO | WO 2011/059836 A2 | 5/2011 |
| WO | WO 2011/097477 A1 | 8/2011 |
| WO | WO 2011/156430 A2 | 12/2011 |
| WO | WO 2012/004299 A1 | 1/2012 |
| WO | WO 2012/012667 A2 | 1/2012 |
| WO | WO 2012/058460 A2 | 5/2012 |
| WO | WO 2012/079000 A1 | 6/2012 |
| WO | WO 2012/079000 A1 | 6/2012 |
| WO | WO 2012/082841 A2 | 6/2012 |
| WO | WO 2012/099973 A2 | 7/2012 |
| WO | WO 2012/127464 A2 | 9/2012 |
| WO | WO 2012/129514 A1 | 9/2012 |
| WO | WO 2012/135854 A2 | 10/2012 |
| WO | WO 2012/138858 A1 | 10/2012 |
| WO | WO 2013/019615 A2 | 2/2013 |
| WO | WO 2013/033626 A2 | 3/2013 |
| WO | WO 2013/040371 A2 | 3/2013 |
| WO | WO 2013/040557 A2 | 3/2013 |
| WO | WO 2013/059593 A1 | 4/2013 |
| WO | WO 2013/074916 A1 | 5/2013 |
| WO | WO 2013/126712 A1 | 8/2013 |
| WO | WO 2013/126729 A1 | 8/2013 |
| WO | WO 2013/126733 A1 | 8/2013 |
| WO | WO 2013/176915 A1 | 11/2013 |
| WO | WO 2013/176916 A1 | 11/2013 |
| WO | WO 2014/011984 A1 | 1/2014 |
| WO | WO 2014/011987 A1 | 1/2014 |
| WO | WO 2014/011988 A2 | 1/2014 |
| WO | WO 2014/011993 A2 | 1/2014 |
| WO | WO 2014/011996 A1 | 1/2014 |
| WO | WO 2014/012001 A2 | 1/2014 |
| WO | WO 2014/031687 A1 | 2/2014 |
| WO | WO 2014/039513 A2 | 3/2014 |
| WO | WO 2014/055442 A2 | 4/2014 |
| WO | WO 2014/055657 A1 | 4/2014 |
| WO | WO 2014/055668 A1 | 4/2014 |
| WO | WO 2014/055771 A1 | 4/2014 |
| WO | WO 2014/059173 A2 | 4/2014 |
| WO | WO 2014/124134 A1 | 8/2014 |
| WO | WO 2014/130635 A1 | 8/2014 |
| WO | WO 2014/138704 A1 | 9/2014 |
| WO | WO 2014/145252 A2 | 9/2014 |
| WO | WO 2014/153270 A1 | 9/2014 |
| WO | WO 2014/165177 A1 | 10/2014 |
| WO | WO 2014/165707 A2 | 10/2014 |
| WO | WO 2014/165825 A2 | 10/2014 |
| WO | WO 2014/184741 A1 | 11/2014 |
| WO | WO 2014/184744 A1 | 11/2014 |
| WO | WO 2014/186585 A2 | 11/2014 |
| WO | WO 2014/190273 A1 | 11/2014 |
| WO | WO 2014/191128 A1 | 12/2014 |
| WO | WO 2014/191521 A2 | 12/2014 |
| WO | WO 2014/191527 A1 | 12/2014 |
| WO | WO 2014/204723 A1 | 12/2014 |
| WO | WO 2015/048577 A2 | 4/2015 |
| WO | WO 2015/073683 A2 | 5/2015 |
| WO | WO 2015/075195 A1 | 5/2015 |
| WO | WO 2015/090229 A1 | 6/2015 |
| WO | WO 2015/090230 A1 | 6/2015 |
| WO | WO 2015/112626 A1 | 7/2015 |
| WO | WO 2015/136001 A1 | 9/2015 |
| WO | WO 2015/142661 A1 | 9/2015 |
| WO | WO 2015/142675 A2 | 9/2015 |
| WO | WO-2015136001 A1 * 9/2015 ........... C12N 5/0636 |
| WO | WO 2015/148860 A1 | 10/2015 |
| WO | WO 2015/157252 A1 | 10/2015 |
| WO | WO 2015/161276 A2 | 10/2015 |
| WO | WO 2015/164740 A1 | 10/2015 |
| WO | WO 2015/164745 A1 | 10/2015 |
| WO | WO 2015/200920 A1 | 12/2015 |
| WO | WO 2016/009326 A1 | 1/2016 |
| WO | WO 2016/011080 A2 | 1/2016 |
| WO | WO 2016/011210 A2 | 1/2016 |
| WO | WO 2016/014501 A1 | 1/2016 |
| WO | WO 2016/014530 A1 | 1/2016 |
| WO | WO 2016/014535 A1 | 1/2016 |
| WO | WO 2016/014553 A1 | 1/2016 |
| WO | WO 2016/014565 A2 | 1/2016 |
| WO | WO 2016/014576 A1 | 1/2016 |
| WO | WO 2016/019300 A1 | 2/2016 |
| WO | WO 2016/021972 A1 | 2/2016 |
| WO | WO 2016/025880 A1 | 2/2016 |
| WO | WO 2016/028896 A1 | 2/2016 |
| WO | WO 2016/044605 A1 | 3/2016 |
| WO | WO 2016/049024 A2 | 3/2016 |
| WO | WO 2016/054032 A1 | 4/2016 |
| WO | WO 2016/057705 A1 | 4/2016 |
| WO | WO 2016/063264 A1 | 4/2016 |
| WO | WO 2016/065329 A1 | 4/2016 |
| WO | WO 2016/069282 A1 | 5/2016 |
| WO | WO 2016/069283 A1 | 5/2016 |
| WO | WO 2016/073955 A2 | 5/2016 |
| WO | WO 2016/109410 A2 | 7/2016 |
| WO | WO 2016/120217 A1 | 8/2016 |
| WO | WO 2016/142532 A1 | 9/2016 |
| WO | WO 2016/146542 A1 | 9/2016 |
| WO | WO 2016/154596 A1 | 9/2016 |
| WO | WO 2016/160721 A1 | 10/2016 |
| WO | WO 2016/164731 A2 | 10/2016 |
| WO | WO 2016/168595 A1 | 10/2016 |
| WO | WO 2016/183041 A2 | 11/2016 |
| WO | WO 2017/015427 A1 | 1/2017 |
| WO | WO 2017/049166 A1 | 3/2017 |
| WO | WO 2017/093969 A1 | 6/2017 |
| WO | WO 2017/117112 A1 | 7/2017 |
| WO | WO 2018/132783 A1 | 7/2018 |
| WO | WO 2018/175733 A1 | 9/2018 |
| WO | WO 2018/198077 A2 | 11/2018 |
| WO | WO 2019/097305 A2 | 5/2019 |
| WO | WO 2019/126574 A1 | 6/2019 |
| WO | WO 2019/237035 A1 | 12/2019 |
| WO | WO 2020/084580 A1 | 4/2020 |
| WO | WO 2021/220132 A1 | 11/2021 |

OTHER PUBLICATIONS

Montague TG, Cruz JM, Gagnon JA, Church GM, Valen E. CHOPCHOP: a CRISPR/Cas9 and TALEN web tool for genome editing. Nucleic acids research. Jul. 1, 2014;42(W1):W401-7. (Year: 2014).*

CHOPCHOP; http://chopchop.cbu.uib.no/; retrieved Dec. 9, 2021 (Year: 2021).*

Hendel A, Bak RO, Clark JT, Kennedy AB, Ryan DE, Roy S, Steinfeld I, Lunstad BD, Kaiser RJ, Wilkens AB, Bacchetta R. Chemically modified guide RNAs enhance CRISPR-Cas genome

(56) References Cited

OTHER PUBLICATIONS editing in human primary cells. Nature biotechnology. Sep. 2015; 33(9):985-9. (Year: 2015).*
ABSS Alignments of Seq ID No. 7858 and US20140273226A1, Seq IDs 16 and 20; alignment Dec. 2021. (Year: 2021).*
Zhang, et al. (2017) "Engineering CAR-T cells", Biomarker Research, 5:22, 6 pages. (Year: 2017).*
Gilham, et al. (2012) "CAR-T cells and solid tumors: tuning T cells to challenge an inveterate foe", Trends in Molecular Medicine, 18(7): 377-84. (Year: 2012).*
Marofi, et al. (2021) "CAR T cells in solid tumors: challenges and opportunities", Stem Cell Research & Therapy, 12:81, 16 pages. (Year: 2021).*
Li, et al. (2014) "Stem Cell Treatment for Alzheimer's Disease", International Journal of Molecule Sciences, 15(10): 19226-38. (Year: 2014).*
Davies, et al. (2014) "Opportunities and limitations of natural killer cells as adoptive therapy for malignant disease", Cytotherapy, 16: 1453-66. (Year: 2014).*
Abaza et al., "Effects of Amino Acid Substitutions Outside an Antigenic Site on Protein Binding to Monoclonal Antibodies of Predetermined Specificity Obtained by Peptide Immunization: Demonstration with Region 94-100 (Antigenic Site 3) of Myoglobin," Journal of Protein Chemistry (1992), vol. 11, No. 5, pp. 433-444.
Almagro et al., "Humanization of Antibodies," Frontiers in Bioscience (2008), vol. 13, pp. 1619-1633.
Attianese et al., "In vitro and in vivo model of a novel immunotherapy approach for chronic lymphocytic leukemia by anti-CD23 chimeric antigen receptor," Blood (2011), vol. 117, No. 18, pp. 4736-4745.
Baeksgaard et al., "Acute tumor lysis syndrome in solid tumors—a case report and review of the literature," Cancer Chemotherapy Pharmacology (2003), vol. 51, pp. 187-192.
Barrett et al., "Relation of clinical culture method to T-cell memory status and efficacy in xenograft models of adoptive immunotherapy," Cytotherapy (2014), vol. 16, No. 5, pp. 619-630.
Barsov "Telomerase and primary T cells: biology and immortalization for adoptive immunotherapy," Immunotherapy (2011), vol. 3, No. 3, pp. 407-421.
Berry al., "Selection of Target Sites for Mobile DNA Integration in the Human Genome," PLoS Comput Biol (2006), vol. 2, No. 11, e157, pp. 1450-1462.
Berry et al., "Comparing DNA integration site clusters with scan statistics," Bioinformatics (2014), vol. 30, pp. 1493-1500.
Berry et al., "Estimating abundances of retroviral insertion sites from DNA fragment length data," Bioinformatics (2012), 28, No. 6, pp. 755-762.
Bondanza et al., "Suicide gene therapy of graft-versus-host disease induced by central memory human T lymphocytes," Blood (2006), vol. 107, No. 5, pp. 1828-1836.
Brady et al., "A method to sequence and quantify DNA integration for monitoring outcome in gene therapy," Nucleic Acids Res (2011), vol. 39, No. 11, e72, pp. 1-8.
Brady et al., "Integration target site selection by a resurrected human endogenous retrovirus," Genes Dev (2009), vol. 23, pp. 633-642.
Brentjens et al., "Treatment of Chronic Lymphocytic Leukemia With Genetically Targeted Autologous T Cells: Case Report of an Unforeseen Adverse Event in a Phase I Clinical Trial," The American Society of Gene Therapy (2010), vol. 18, No. 4, pp. 666-668.
Brentjens et al., "A Phase I Trial for the Treatment of chemo-Refractory Chronic Lymphocytic Leukemia with CD19-Targeted Autologous T Cells," Molecular Therapy (2008), vol. 16, Suppl. 1, p. S15.
Brentjens et al., "CD19-Targeted T Cells Rapidly Induce Molecular Remissions in Adults with Chemotherapy-Refractory Acute Lymphoblastic Leukemia," Sci. Transl. Med. 5:177ra138 (2013).
Brentjens et al., "Eradication of systemic B-cell tumors by genetically targeted human T lymphocytes co-stimulated by CD80 and interleukin-15," Nature Medicine (2003), vol. 9, No. 3, pp. 279-286.
Brentjens et al., "Genetically Targeted T Cells Eradicate Systemic Acute Lymphoblastic Leukemia Xenografts," Clinical Cancer Research (2007), vol. 13, No. 18, pp. 5426-5435.a.
Brentjens et al., "Safety and persistence of adoptively transferred autologous CD19-targeted T cells in patients with relapsed or chemotherapy refractory B-cell leukemias," Blood (2011). vol. 118, No. 18, pp. 4817-4828.
Brocker et al., "Signals through T Cell Receptor—Chain alone are Insufficient to Prime Resting T Lymphocytes," J. Exp. Med. (1995), vol. 181, pp. 1653-1659.
Buenrostro et al., "Transposition of native chromatin for multimodal regulatory analysis and personal epigenomics," Nat Methods (2013), vol. 10, No. 12, pp. 1213-1218.
Busque et al., "Recurrent Somatic TET2 Mutations in Normal Elderly Individuals With Clonal Hematopoiesis," Nature Genetics (2012), vol. 44, pp. 1179-1181.
Call "The T Cell Receptor: Critical Role of the Membrane Environment in Receptor Assembly and Function," Annu. Rev. Immunol. (2005), vol. 23, pp. 101-125.
Carpenito et al., "Control of large, established tumor xenografts with genetically retargeted human T cells containing CD28 and CD137 domains," Proc Natl Acad Sci USA (2009), vol. 106, pp. 3360-3365.
Carty et al., "The loss of TET2 promotes CD8+ T cell memory differentiation," J Immunol (2017), vol. 200, No. 1, pp. 82-91.
Cha et al., "IL-7 + IL-15 are superior to IL-2 for the ex vivo expansion of 4T1 mammary carcinoma-specific T cells with greater efficacy against tumors in vivo," Breast Cancer Research and Treatment, Kluwer Academic Publishers (2009), vol. 122, No. 2, pp. 359-369.
Cheadle et al., "CAR T cells: driving the road from the laboratory to the clinic," Immunological Reviews (2013), vol. 257, No. 1, pp. 91-106.
Colman et al., "Effects of amino acid sequence changes on antibody-antigen interactions," Research in Immunology (1994), vol. 145, No. 1, pp. 33-36.
Couper et al., "Anti-CD25 antibody-mediated depletion of effector T cell populations enhances susceptibility of mice to acute but not chronic Toxoplasma gondii infection," The Journal of Immunology (2009), vol. 182, No. 7, pp. 3985-3994.
Daber et al., "Understanding the limitations of next generation sequencing informatics, an approach to clinical pipeline validation using artificial data sets," Cancer Genet (2013), vol. 206, No. 12, pp. 441-448.
Database Biosis [Online], Database accession No. PREV201700298608 dated Dec. 2, 2016.
Davila et al., "B Cell Aplasia In a Patient with Relapsed B Cell Acute Lymphoblastic Leukemia Following Re-Induction and Consolidation with Autologous T Cells Genetically Targeted to the CD19 Antigen," 53rd ASH Annual Meeting and Exposition (2010) Oral and Poster Abstract.
Döhner et al., "p53 Gene Deletion Predicts for Poor Survival and Non-Response to Therapy With Purine Analogs in Chronic B-Cell Leukemias," Blood (1995), vol. 85, No. 6, pp. 1580-1589.
Dotti et al., "Design and development of therapies using chimeric antigen receptor-expressing T cells," Immunological Reviews (2013), vol. 257, No. 1, pp. 107-126.
Dropulic et al., "Gene-Based Immunotherapy for Human Immunodeficiency Virus Infection and Acquired Immunodeficiency Syndrome," Human Gene Therapy (2006), vol. 17, pp. 577-588.
Dull et al, "A Third-Generation Lentivirus Vector with a Conditional Packaging System," Journal of Virology (1998), vol. 72, No. 11, pp. 8463-8471.
Efimova et al., "The hydroxyl form of 5-methylcytosine-5-hydroxymethylcytosine: a new look at the biological role in the mammalian genome," Ekologicheskaya genetika, Ecological Genetics. (2014), vol. 12, No. 1, pp. 3-13.
Eshhar et al., "Specific activation and targeting of cytotoxic lymphocytes through chimeric single chains consisting of antibody-binding domains and the γ or ζsubunits of the immunoglobulin and T-cell receptors," PNAS USA (1993) 90: 720-724.
Finney et al., "Activation of resting human primary T cells with chimeric receptors: costimulation from CD28, inducible costimula-

(56) References Cited

OTHER PUBLICATIONS tor, CD134, and CD137 (4-1BB) in series with signals from the TCR zeta chain," J. Immunol. (2004) 172: 104-113.
Finney et al., "Chimeric receptors providing both primary and costimulatory signaling in T cells from a single gene product," J. Immunol. (1998) 161: 2791-2797.
Flynn et al., "Stem memory T cells (TSCM)-their role in cancer and HIV immunotherapies," Clinical & Translational Immunology (2014), vol. 3, No. 7, pp. 1-7.
Fraietta et al, "Disruption of TET2 promotes the therapeutic efficacy of CD19-targeted T cells, " Nature (2018), vol. 558, No. 7709, pp. 307-312.
Fraietta et al., "Ibrutinib enhances chimeric antigen receptor T-cell engraftment and efficacy in leukemia," Blood (2016), vol. 127, No. 9, pp. 1117-1127.
Frey, "Genetically Engineered Lymphocyte Therapy in Treating Patients With B-Cell Leukemia or Lymphoma That is Resistant or Refractory to Chemotherapy," (2015) Clinical Trial NCT01029366.
Friedmann-Morvinski et al., "Redirected primary T cells harboring a chimeric receptor require costimulation for their antigen-specific activation," Blood (2005) 105: 3087-3093.
Fujiwara et al., "Profiles of De Novo CD25-Positive Mature B-Cell Lymphomas," Blood (2013), vol. 122, No. 21, pp. 4308 (1-6).
Geiger et al., "Development and Application of Receptor-Modified T Lymphocytes for Adoptive Immunotherapy," Transfusion Medicine Reviews (2001), vol. 15, No. 1, pp. 21-34.
Geiger et al., "Integrated src kinase and constimulatory activity enhances signal transduction through single-chain chimeric receptors in T lymphocytes," Blood 98(8): 2364-2371 (2001).
GenBank Accession No. NP_000725.1 accessed on Jan. 7, 2016 from http://www.ncbi.nlm.nih.gov/protein/NP_000725.
GenBank Accession No. NP_932170.1 accessed Jan. 7, 2016 from http://www.ncbi.nlm.nih.gov/protein/NP_932170.
Gerriets et al., "Metabolic programming and PDHK1 control CD4+ T cell subsets and inflammation," The Journal of Clinical Investigation (2015), vol. 125, No. 1, pp. 194-207.
Gilham et al., "Primary Polyclonal Human T Lymphocytes Targeted to Carcino-Embryonic Antigens and Neural Cell Adhesion Molecule Tumor Antigens by CD3-Based Chimeric Immune Receptors," Journal of Immunotherapy (2002), vol. 25, No. 2, pp. 139-151.
Gong et al., "Cancer Patient T Cells Genetically Targeted to Prostate-Specific Membrane Antigen Specifically Lyse Prostate Cancer Cells and Release Cytokines in Response to Prostate-Specific Membrane Antigen," Neoplasia (1999), vol. 1, No. 2, pp. 123-127.
Gribben et al., "Stem cell transplantation for indolent lymphoma and chronic lymphocytic leukemia," Biol Blood Marrow Transplant (2011), vol. 17, (1 Suppl): S63-S70.
Griffin et al., "Development and applications of surface-linked single chain antibodies against T-cell antigens," Journal of Immunological Methods (2001), vol. 248, pp. 77-90.
Gross et al, "Expression of immunoglobulin-T-cell receptor chimeric molecules as functional receptors with antibody-type specificity," PNAS (1989), vol. 86, pp. 10024-10028.
Gross et al., "Endowing T cells with antibody specificity using chimeric T cell receptors," The FASEB Journal (1992) 6:3370-3378.
Grupp et al., "Chimeric Antigen Receptor-Modified T Cells for Acute Lymphoid Leukemia," New England Journal of Medicine (2013), vol. 368, No. 16, pp. 1509-1518.
Hallek et al., "Guidelines for the diagnosis and treatment of chronic lymphocytic leukemia: a report from the International Workshop on Chronic Lymphocytic Leukemia updating the National Cancer Institute Working Group 1996 guidelines," Blood (2008), vol. 111, No. 12, pp. 5446-5456.
Han et al., "Malignant B Cells Induce the Conversion of CD4+ CD25-T Cells to Regulatory T Cells in B-Cell Non-Hodgkin Lymphoma," PLoS One (2011), vol. 6, No. 12, e28649.
Hekele et al., "Growth Retardation of Tumors by Adoptive Transfer of Cytotoxic T Lymphocytes Reprogrammed by CD44V6-Specific SCFV:ζ-Chimera," Int J. Cancer (1996), vol. 68, pp. 232-238.
Hernandez-Sanchez et al., "TET2 Overexpression in Chronic Lymphocytic Leukemia Is Unrelated to the Presence of TET2 Variations," BioMed Research International (2014) Article ID 814294, pp. 1-6.
Ho et al., "Adoptive immunotherapy: Engineering T cell responses as biological weapons for tumor mass destruction," Cancer Cell (2003), vol. 3, pp. 431-437.
Hollyman et al., "Manufacturing validation of biologically functional T cells targeted to CD19 antigen for autologous adoptive cell therapy," J Immunother (2009), vol. 32, No. 2, pp. 169-180.
Hombach et al., "The Recombinant T Cell Receptor Strategy: Insights into Structure and Function of Recombinant Immunoreceptors on the Way Towards an Optimal Receptor Design for Cellular Immunotherapy," Current Gene Therapy (2002) 2: 211-226.
Horii et al., "Genome Engineering of Mammalian Haploid Embryonic Stem Cells Using the Cas9/RNA System," PeerJ, © 2013 Horii et al., 14 pages.
Hosing et al., "CARs in Chronic Lymphocytic Leukemia—Ready to Drive," Current Hematologic Malignancy Reports (2012), vol. 8, No. 1, pp. 60-70.
Husebekk et al., "Selection and expansion of T cells from untreated patients with CLL: source of cells for immune reconstitution?," Cytotherapy (2000), vol. 2, No. 3, pp. 187-193.
Ikeda et al., "Recurrent HIV-1 Integration at the BACH2 Locus in Resting CD4+ T Cell Populations during Effective Highly Active Antiretroviral Therapy," The Journal of Infectious Diseases (2007), vol. 195, pp. 716-725.
Imai et al., "Chimeric receptors with 4-1BB signaling capacity provoke potent cytotoxicity against acute lymphoblastic leukemia," Leukemia, 18: 676-684 (2004).
Imai et al., "Genetic modification of primary natural killer cells overcomes inhibitory signals and induces specific killing of leukemic cells," Blood (2005), vol. 106, No. 1, pp. 376-383.
International Search Report and Written Opinion for International Application No. PCT/US2015/067635 dated Jun. 28, 2016.
International Search Report and Written Opinion for International Application No. PCT/US2016/043255 dated Dec. 16, 2016.
International Search Report and Written Opinion for International Application No. PCT/US2016/052260 dated Jan. 16, 2017.
International Search Report and Written Opinion for International Application No. PCT/US2016/068683 dated Jun. 1, 2017.
International Search Report and Written Opinion for International Application No. PCT/US2018/023785 dated Sep. 6, 2018.
International Search Report and Written Opinion from International Application No. PCT/US2011/064191 dated May 1, 2012.
International Search Report and Written Opinion from International Application No. PCT/US2016/027751 dated Jul. 1, 2016.
Irving et al., "The cytoplasmic domain of the T cell receptor zeta chain is sufficient to couple to receptor-associated signal transduction pathways," Cell (1991) 64: 891-901.
Iyer et al., "Prediction of novel families of enzymes involved in oxidative and other complex modifications of bases in nucleic acids," Cell Cycle (2009), vol. 8, No. 11, pp. 1698-1710.
Jena et al., "Chimeric Antigen Receptor (CAR)-Specific Monoclonal Antibody to Detect CD19-Specific T Cells in Clinical Trials," PLoS One (2013), vol. 8, No. 3, e57838, pp. 1-12.
Jena et al., "Redirecting T-cell specificity by introducing a tumor-specific chimeric antigen receptor," Blood, May 3, 2010, vol. 116, No. 7, pp. 1035-1044.
Jensen. et al., "Anti-Transgene Rejection Responses Contribute to Attenuated Persistence of Adoptively Transferred CD20/CD19-Specific Chimeric Antigen Receptor Re-directed T Cells in Humans," Biol Blood Marrow Transplant (2010), vol. 16, No. 9, pp. 1245-1256.
Jin et al., "Simplified Method of the Growth of Human Tumor Infiltrating Lymphocytes (TIL) in Gas-Permeable Flasks to Numbers Needed for Patient Treatment," J Immunother (2012), vol. 35, No. 3, pp. 283-292.

(56) References Cited

OTHER PUBLICATIONS

Johnson et al., "Gene therapy with human and mouse T-cell receptors mediates cancer regression and targets normal tissues expressing cognate antigen," Blood (2009), vol. 114, No. 3, pp. 535-545.
Jones et al., "Circulating clonotypic B cells in classic Hodgkin lymphoma," Blood (2009), vol. 113, No. 23, pp. 5920-5926.
Joo et al., "Targeted cancer therapy—are the days of systemic chemotherapy numbered?," Maturitas (2013), vol. 76, No. 4, pp. 308-314.
June et al., "Engineering lymphocyte subsets: tools, trials and tribulations," Nat Rev Immunol, (2009), vol. 9, No. 10, pp. 704-716.
Kalos et al., "T Cells with Chimeric Antigen Receptors Have Potent Antitumor Effects and Can Establish Memory in Patients with Advanced Leukemia," Science Translation Medicine (2011), vol. 3, No. 95, 95ra73.
Kershaw et al., "A Phase I Study on Adoptive Immunotherapy Using Gene-Modified T Cells for Ovarian Cancer," Clin. Cancer Res. (2006) 12(20 Pt 1): 6106-6115.
Kim et al., "Human 4-1BB regulates CD28 co-stimulation to promote Th1 cell responses," Eur. J. Immunol. (1998), vol. 28, pp. 881-890.
Kmieciak et al., "Ex vivo Expansion of Tumor-reactive T Cells by Means of Byrostatin 1/Ionomycin and the Common Gamma Chain Cytokines Formulation," Journal of Visualized Experiments (2011) vol. 47, doi: 10.3791/2381, pp. 1-4.
Kochenderfer et al, "A Phase I Clinical Trial of Treatment of B-Cell Malignancies with Autologous Anti-Cd19-CAR-Transduced T Cells," Blood (2010) vol. 116 No. 21 pp. 1179-1180 & 52nd Annual Meeting of the American-Society-of-Hematology (ASH); Orlando, FL, USA; Dec. 4-7, 2010 abstract.
Kochenderfer et al., "Construction and Pre-clinical Evaluation of an Anti-CD19 Chimeric Antigen Receptor," J Immunother (2009), vol. 32, No. 7, pp. 689-702.
Kochenderfer et al., "Eradication of B-lineage cells and regression of lymphoma in a patient treated with autologous T cells genetically-engineered to recognize CD19," Blood 116: 4099-4102 (2010).
Koehler et al., "Engineered T Cells for the Adoptive Therapy of B-Cell Chronic Lymphocytic Leukaemia," Advances in Hematology (2012), vol. 180, No. 9, pp. 6365-13.
Kohn et al., "CARs on Track in the Clinic," Molecular Therapy (2011), vol. 19, No. 3, pp. 432-438.
Krause et al., "Antigen-dependent CD28 Signaling Selectively Enhances Survival and Proliferation in Genetically Modified Activated Human Primary T Lymphocytes," J. Exp. Med. (1998), vol. 188, Np. 4, pp. 619-626.
Kunimoto et al., "Tet2 disruption leads to enhanced self-renewal and altered differentiation of fetal liver hematopoietic stem cells," s.Scentific Reports 2(273) 10 pgs. (2012) DOI 1038/srep00273.
Kwon et al., "cDNA sequences of two inducible T-cell genes," Proc. Natl. Acad. Sci. U.S.A., (1989) 86(6): 1963-1967.
Lamanna et al., "Pentostatin, Cyclophosphamide, and Rutuximab Is an Active, Well-Tolerated Regimen for Patients With Previously Treated Chronic Lymphocytic Leukemia," Journal of Clinical Oncology (2008), vol. 24, No. 10, pp. 1575-1581.
Lamers et al., "Treatment of Metastatic Renal Cell Carcinoma With Autologous T-Lymphocytes Genetically Retargeted Against Carbonic Anhydrase IX: First Clinical Experience," J. Clin. Oncol. (2006) 24(13): e20-e22.
Laport et al., "Adoptive transfer of costimulated T cells induces lymphocytosis in patients with relapsed/refractory non-Hodgkin lymphoma following CD34 +-selected hematopoietic cell transplantation," Blood (2003), vol. 102, No. 6, pp. 2004-2013.
Laukka et al., "Fumarate and Succinate Regulate Expression of Hypoxia-inducible Genes via TET Enzymes," The Journal of Biological Chemistry (2016), vol. 291, No. 8, pp. 4256-4265.
Lee et al., "T cells expressing CD19 chimeric antigen receptors for acute lymphoblastic leukaemia in children and young adults: a phase 1 dose escalation trial," Lancet (2014), vol. 385, No. 9967, pp. 517-528.

Lee et al., "The Future is Now: Chimeric Antigen Receptors as New Targeted Therapies for Childhood Cancer," Clin. Cancer Res.(2012) 18: 2780-2790.
Lee et al., "In vivo Inhibition of Human CD19-Targeted Effector T Cells by Natural T Regulatory Cells in a Xenotransplant Murine Model of B Cell Malignancy," Cancer Research (2011), vol. 71, No. 8, pp. 2871-2881.
Letourneur et al., "T-cell and basophil activation through the cytoplasmic tail of T-cell-receptor zeta family proteins," Proc. Natl. Acad. Sci. U.S.A (1991) 88: 8905-8909.
Levine et al., "Gene transfer in humans using a conditionally replicating lentiviral vector," PNAS (2006), vol. 103, No. 46, pp. 17372-17377.
Lipowska-Bhalla et al., "Targeted immunotherapy of cancer with CAR T cells: achievements and challenges," Cancer Immunology Immunotherapy (2012), vol. 61, pp. 953-962.
Macallan et al., "Measurement and modeling of human T cell kinetics, " European Journal of Immunology (2003), vol. 33, pp. 2316-2326.
Maher et al., "Human T lymphocyte cytotoxicity and proliferation directed by a single chimeric TCRzeta/CD28 receptor," Nat. Biotechnol. (2002) 20: 70-75.
Maude et al., "Chimeric Antigen Receptor T Cells for Sustained Remissions in Leukemia," The New England Journal of Medicine (2014), vol. 371, No. 16, pp. 1507-1517.
McGuinness et al., "Anti-tumor activity of human T cells expressing the CC49-ζ chimeric immune receptor," Hum. Gene Ther.(1999) 10: 165-173.
Milone et al, "Chimeric Receptors Containing CD137 Signal Transduction Domains Mediate Enhanced Survival of T Cells and Increased Antileukemic Efficacy In Vivo," Molecular Therapy (2009), vol. 17, No. 8, pp. 1453-1464.
Molina, "A Decade of Rituximab: Improving Survival Outcomes in Non-Hodgkin's Lymphoma," Annu. Rev. Med. (2008), vol. 59, pp. 237-250.
Moran-Crusio et al., "Tet2 Loss Leads to Increased Hematopoietic Stem Cell Self-Renewal and Myeloid Transformation," Cancer Cell, Cell Press Article, vol. 20, No. 1, Jun. 6, 2011, 14 pages.
Morgan et al., "Case Report of a Serious Adverse Event Following the Administration of T Cells Transduced With a Chimeric Anitgen Receptor Recognizing ErbB2," Mol. Ther. 18(4): 843-851 (2010).
Moritz et al., "A spacer region between the single chain antibody- and the CD3 zeta-chain domain of chimeric T cell receptor components is required for efficient ligand binding and signaling activity," Gene Therapy 2(8): 539-546 (1995).
Moritz et al., "Cytotoxic T lymphocytes with a grafted recognition specificity for ERBB2-expressing tumor cells," Proc. Natl. Acad. Sci (1994), vol. 91, pp. 4318-4322.
Muthusamy et al., "Defective activation and survival of T cells lacking the Ets-1 transcription factor," Nature (1995), vol. 377, pp. 639-642.
Naldini et al., "In Vivo Gene Delivery and Stable Transduction of Nondividing Cells by a Lentiviral Vector," Science (1996), vol. 272, pp. 263-267.
NCBI accession HM_852952 accessed Sep. 29, 2015 from http://www.ncbi.nlm.nih.gov/nuccore/hm852952.
Nicholson et al., "Construction and Characterisation of a Function CD19 Specific Single Chain Fv Fragment for Immunotherapy of B Lineage Leukaemia and Lymphoma," Molecular Immunology 34(16-17): 1157-1165 (1997).
Ninomiya et al, "Tumor indoleamine 2,3-dioxygenase (IDO) inhibits CD19-CAR T cells and is downregulated by lymphodepleting drugs," Blood (2015), vol. 125, No. 25, pp. 3905-3916.
Ocwieja et al., "HIV Integration Targeting: A Pathway Involving Transportin-3 and the Nuclear Pore Protein RanBP2," PLoS Pathog (2011), vol. 7, No. 3, e1001313, pp. 1-14.
Park et al., "Adoptive Immunotherapy for B-cell Malignancies with Autologous Chimeric Antigen Receptor Modified Tumor Targeted T Cells," Discovery Medicine (2010), vol. 9, No. 47, pp. 277-288.
Park et al., "Adoptive Transfer of Chimeric Antigen Receptor Re-directed Cytolytic T Lymphocyte Clones in Patients with Neuroblastoma," Molecular Therapy (2007), vol. 15, No. 4, pp. 825-833.

(56) References Cited

OTHER PUBLICATIONS

Partial Search Report and Invitation to Pay Additional Fees for International Application No. PCT/US2016/052260 dated Nov. 16, 2016.
Patel et al., "Impact of chimeric immune receptor extracellular protein domains on T cell function," Gene Therapy (1999), vol. 6, pp. 412-419.
Pauken et al., "Epigenetic stability of exhausted T cells limits durability of reinvigoration by PD-1 blockade," Science (2016), vol. 354, No. 6316, pp. 1160-1165.
PCT International Preliminary Report on Patentability Chapter I issued in International Application No. PCT/US2018/023631 dated Sep. 24, 2019, 11 pages.
PCT International Preliminary Report on Patentability issued in PCT/US2019/036111, dated Dec. 8, 2020, 12 pgs.
PCT International Search Report issued in International Application No. PCT/US2018/023631 dated Oct. 25, 2018, 7 pages.
PCT International Search Report issued in PCT/US2019/036111, dated Nov. 7, 2019, 7 pgs.
PCT Written Opinion of the International Searching Authority issued in International Application No. PCT/US2018/023631 dated Oct. 22, 2018, 10 pages.
PCT Written Opinion of the International Searching Authority issued in PCT/US2019/036111, dated Nov. 7, 2019, 11 pgs.
Piper et al., "Chronic lymphocytic leukemia cells drive the global CD4+ T cell repertoire towards a regulatory phenotype and leads to the accumulation of CD4+ forkhead box P3+ T cells," Clinical and Experimental Immunology (2011), vol. 166, No. 2, pp. 154-163.
Porter et al., "Chimeric antigen receptor T cells persist and induce sustained remissions in relapsed refractory chronic lymphocytic leukemia," Science Translational Medicine (2015), vol. 7, No. 303, ra139, pp. 1-25.
Porter et al., "A phase 1 trial of donor lymphocyte infusions expanded and activated ex vivo via CD3/CD28 costimulation," Blood (2006), vol. 107, No. 4, pp. 1325-1331.
Porter et al., "Chimeric Antigen Receptor-Modified T Cells in Chronic Lymphoid Leukemia," The New England Journal of Medicine (2011), vol. 365, No. 8, pp. 725-733.
Porter et al., "Chimeric Antigen Receptor Therapy for B-cell Malignancies," Journal of Cancer (2011), vol. 2, pp. 331-332.
Powell et al., "Large-Scale Depletion of CD25+ Regulatory T Cells from Patient Leukapheresis Samples," Journal of Immunotherapy (2005), vol. 28, No. 4, pp. 403-411.
Powell et al., "Partial Reduction of Human FOXP3+ CD4 T Cells In Vivo After CD25-directed Recombinant Immunotoxin Administration," J Immunother (2008), vol. 31, pp. 189-198.
Priceman et al., "Smart CARs Engineered for Cancer Immunotherapy," Curr Opin Oncol (2015), vol. 27, No. 6, pp. 466-474.
Pronier et al., "Inhibition of TET2-mediated conversion of 5-methylcytosine to 5-hydroxymethylcytosine disturbs erythroid and granulomonocytic differentiation of human hematopoietic progenitors," Blood (2011), vol. 118, No. 9, pp. 2551-2555.
Pule, M. A. et al., "Virus-specific T cells engineered to coexpress tumor-specific receptors: persistence and antitumor activity in individuals with neuroblastoma," Nat. Med. (2008). Vol. 14, No. 11, pp. 1264-1270.
Rapoport et al., "Restoration of immunity in lymphopenic individuals with cancer by vaccination and adoptive T-cell transfer," Nature Medicine (2005), vol. 11, No. 11, pp. 1230-1237.
Roederer, "T-cell dynamics of immunodeficiency," Nature Medicine (1995), vol. 1, No. 7, pp. 621-622.
Romeo et al., "Cellular immunity to HIV activated by CD4 fused to T cell or Fc receptor polypeptides," Cell (1991) 64:1037-1046.
Rudikoff et al., "Single amino acid substitution altering antigen-binding specificity," PNAS (1982), vol. 79, pp. 1979-1983.
Rufer et al., "Transfer of the human telomerase reverse transcriptase (TERT) gene into T lymphocytes results in extension of replicative potential," Blood (2001), pp. 597-603.
Sabbagh et al., "TNF family ligands define niches for T cell memory," Trends in Immunology (2007), vol. 28, No. 8, pp. 333-339.
Sadelain et al., "The promise and potential pitfalls of chimeric antigen receptors," Current Opinion Immunology (2009), vol. 21, No. 2, pp. 215-223.
Sadelain et al., "Targeting Tumours with Genetically Enhanced T Lymphocytes," Nature Reviews: Cancer (2003) 3: 35-45.
Savoldo et al., "CD28 costimulation improves expansion and persistence of chimeric antigen receptor-modified T cells in lymphoma patients," The Journal of Clinical Investigation (2011), vol. 121, No. 5, pp. 1822-1826.
Scholler et al., "Decade-Long Safety and Function of Retroviral-Modified Chimeric Antigen Receptor T-cells," Science Translational Medicine (2012) vol. 4, No. 132, ra153, pp. 1-16.
Scourzic et al., "TET Proteins and the Control of Cytosine Demethylation in Cancer," Genome Medicine (2015), vol. 7, No. 1, © Scourzic et al, licensee BioMed Central, 16 pages.
Sebestyén et al., "Human TCR That Incorporate CD3Z Induce Highly Preferred Pairing between TCR α and β Chains following Gene Transfer," Journal of Immunology (2008), vol. 180, pp. 7736-7746.
Shide et al., "TET2 is Essential for Survival and Hematopoietic Stem Cell Homeostasis," Leukemia (2012) 26, © 2012 Macmillan Publishers Limited, www.nature.com/leu, pp. 2216-2223.
Shirasun. et al., "Functional Design of Chimeric T-Cell Antigen Receptors for Adoptive Immunotherapy of Cancer: Architecture and Outcomes," AntiCancer Res. (2012) 32: 2377-2384.
Shvidel et al., "Cell surface expression of CD25 antigen (surface IL-2 receptor alpha-chain) is not a prognostic marker in chronic lymphocytic leukemia: results of a retrospective study of 281 patients," Ann Hematol (2012), vol. 91, pp. 1597-1602.
Singapore Search Report and Written Opinion for Singapore Application No. 11201705293W dated Mar. 22, 2018.
Singapore Search Report and Written Opinion for Singapore Application No. 11201708516Y dated Sep. 25, 2018.
Singh et al., "Early memory phenotypes drive T cell proliferation in patients with pediatric malignancies," Science Translational Medicine (2012), vol. 8, No. 320, pp. 320ra3-320ra3.
Slaney et al., "Dual-specific Chimeric Antigen Receptor T Cells and an Indirect Vaccine Eradicate a Variety of Large Solid Tumors in an Immunocompetent Self-antigen Setting," Clinical Cancer Research (2017), vol. 23, No. 10, pp. 2478-2490.
Sorror et al., "Outcomes after allogeneic hematopoietic cell transplantation with nonmyeloablative or myeloablative conditioning regimens for treatment of lymphoma and chronic lymphocytic leukemia," Blood (2008), vol. 111, No. 1, pp. 446-452.
Stroncek et al., "Highlights of the society for immunotherapy of cancer (SITC) 27th annual meeting," Journal for ImmunoTherapy of Cancer (2013), vol. 1, No. 4, pp. 1-11.
Tahiliani et al., "Conversion of 5-Methylcytosine to 5-Hydroxymethylcytosine in Mammalian DNA by MLL Partner TET1," Science (2009), vol. 324, pp. 930-935.
Taylor et al., "IL-10 suppresses CD2-mediated T cell activation via SHP-1," Molecular Immunology (2009), vol. 46, pp. 622-629.
Terakura et al., "Generation of CD19-chimeric antigen receptor modified CD8+ T cells derived from virus-specific central memory T cells," Blood (2012), vol. 119, No. 1, pp. 72-82.
Till et al., "Adoptive immunotherapy for indolent non-Hodgkin lymphoma and mantle cell lymphoma using genetically modified autologous CD20-specific T cells," Blood (2008), vol. 112, No. 6, pp. 2261-2271.
Tretter et al., "Succinate, an intermediate in metabolism, signal transduction, ROS, hypoxia, and tumorigenesis," Biochimica et Biophysica Acta (2016), vol. 1857, pp. 1086-1101.
Tsukumo et al., "Bach2 maintains T cells in a naive state by suppressing effector memory-related genes," PNAS (2013), vol. 110, No. 26, pp. 10735-10740.
Uckun et al., "Detailed studies on expression and function of CD19 surface determinant by using B43 monoclonal antibody and the clinical potential of anti-CD19 immunotoxins," Blood (1988), vol. 71, pp. 13-29.

(56) References Cited

OTHER PUBLICATIONS

Urak et al., "Ex vivo Akt inhibition promotes the generation of potent CD19CAR T cells for adoptive immunotherapy," Journal for Immunotherapy of Cancer (2017), vol. 5, No. 1, pp. 7-13.
Verbinnen et al., "Contribution of Regulatory T Cells and Effector T Cell Deletion in Tolerance Induction by Costimulation Blockade1," Journal of Immunology (2008), vol. 181, pp. 1034-1042.
Vinay et al., "Role of 4-1BB in immune responses," Immunology (1998), vol. 10, pp. 481-489.
Wang et al., "CS-1 Re-Directed Central Memory T Cell Therapy for Multiple Myeloma," Blood (2014), vol. 124, No. 21, Meeting Abstract 1114.
Wang et al., "Phenotypic and Functional Attributes of Lentivirus Modified CD19-specific Human $CD8^+$ Central Memory T Cells Manufactured at Clinical Scale," J. Immunother (2012), vol. 35, No. 9, pp. 689-701.
Wilkie et al., "Dual Targeting of ErbB2 and MUC1 in Breast Cancer Using Chimeric Antigen Receptors Engineered to Provide Complementary Signaling," J Clin Immunol (2012), vol. 32, pp. 1059-1070.
Willemsen et al., "Genetic Engineering of T Cell Specificity for Immunotherapy of Cancer," Human Immunology (2003), vol. 64, pp. 56-68.
Wu et al., "Suppression of TET1-Dependent DNA Demethylation Is Essential for KRAS-Mediated Transformation," Cell Reports (2014), vol. 9, pp. 1827-1840.
Xu et al., "Oncometabolite 2-Hydroxyglutarate Is a Comparative Inhibitor of alpha-Ketoglutarate-Dependent Dioxygenases," Cancer Cell (2011), vol. 19, No. 1, pp. 17-30.
Yeh et al., "Mutation of epigenetic regulators TET2 and MLL3 in patients with HTLV-I-induced acute adult T-cell leukemia," Molecular Cancer (2016), vol. 15, No. 15, pp. 1-7.
Zang et al., "Mutations in 5-methylcytosine oxidase TET2 and RhoA cooperatively disrupt T cell homeostasis," The Journal of Clinical Investigation (2017), vol. 127, pp. 2998-3012.
Zhang et al., "Efficiency of CD19 chimeric antigen receptor-modified T cells for treatment of B cell malignancies in phase I clinical trials: a meta analysis," Oncotarget (2015), vol. 6, No. 32, pp. 33961-33971.
Zhang et al., "Down-regulation of TET2 in $CD3^+$ and $CD34^+$ cells of myelodysplastic syndromes and enhances $CD34^+$ cells proliferation," Int J Clin Exp Pathol (2015), vol. 8, No. 9, pp. 10840-10846.
Zhao et al., "A Herceptin-Based Chimeric Antigen Receptor with Modified Signaling Domains Leads to Enhanced Survival of Transduced T Lymphocytes and Antitumor Activity," The Journal of Immunology (2009), vol. 183, pp. 5563-5574.
Zufferey et al., "Multiply attenuated lentiviral vector achieves efficient gene delivery in vivo," Nature Biotechnology (1997), vol. 15, pp. 871-876.
Nemudryi, A.A. et al., "TALEN and CRISPR/Cas Genome Editing Systems: Tools of Discovery," Acta Naturae, Jul. 2014, vol. 6, No. 3, Copyright © 2014 Park-media, Ltd., pp. 19-40.
Database WPI Week 201572, Derwent World Patents Index, AN 2015-42037B, XP002767532,.
Gilbert, Luke A. et al., "Genome-Scale CRISPR-Mediated Control of Gene Repression and Activation," Cell, vol. 159, No. 3, Oct. 9, 2014, pp. 647-661, © 2014 Elsevier Inc.
Mandal, Pankaj K. et al., "Efficient Ablation of Genes in Human Hematopoietic Stem and Effector Cells Using CRISPR/Cas9," Cell Stem Cell, Nov. 6, 2014, 15(5):643-52, vol. 15, No. 5., © 2014 Elsevier Inc.
PCT International Search Report issued in International Application No. PCT/IB2016/057318 dated May 9, 2017, 9 pages.
PCT Written Opinion of the International Searching Authority issued in International Application No. PCT/IB2016/057318 dated Jun. 8, 2017, 14 pages.
Ren, Jiangtao et al., "Multiplex Cripsr/Cas9 Genome Editing to Generate Potent Universal CART and PD1—Deficient Cells Against Leukemia," Blood 2015 126:4280; © 2015 by The American Society of Hematology.

Sato, Takehito et al., "Establishment of β2-microglobulin deficient human iPS cells using CRISPR/Cas9 system," Integrative Molecular Medicine, vol. 2(6), pp. 373-377.
Torikai, Hiroki et al., "A Foundation for Universal T-Cell Based Immunotherapy: T Cells Engineered to Express a CD-Specific Chimeric-Antigen-Receptor and Eliminate Expression of Endogenous TCR," Blood, Jun. 14, 2012, vol. 1192, No. 24, pp. 5697-5705, 10 pgs., from www.bloodjournal.org by guest on Dec. 11, 2018, © 2012 by The American Society of Hematology.
Appel et al. "Nucleic Acids: from A to Z" pp. 221, 2013, edited by S. Muller translated from English,—Moscow: BINOM, Laboratoriya znanii, 2013 backbone (p. 221).
Amescua et al., "Limbal stem cell transplantation: current perspectives", Clin Opthalmol., Apr. 1, 2016;10:593-602.
Appel et al. "Nucleic Acids: from A to Z" p. 221, 2013, edited by S. Muller translated from English,—Moscow: BINOM, Laboratoriya znanii, 2013 backbone (p. 221).
Bernal et al. "Implication of the β2-microglobulin gene in the generation of tumor escape phenotypes," Cancer Immunol. Immunother., 2012, v.61, p. 1359-1371.
Carty et al. (2014) "TET2 Regulates CD8+ T Cell Differentiation," Blood 124, Abstract 203.
CHOPCHOP, chopchop.cbu.uib.no/results/1642721720510.5486/ last accessed Jan. 20, 2022.
Dang et al. "Optimizing sgRNA structure to improve CRISPR-Cas9 knockout efficiency," Genome Biol. 2015, 16:280 (10 pages).
Edit-R predesigned crRNA; product description downloaded from the internet on Mar. 30, 2022.
Gen Bank NC_000004.12, Homo sapiens Chromosome 4, GRCh38. p13, region 105269700 to 10527600; 2021.
Hendel et al. "Chemically modified guide RNAs enhance CRISPR-Cas genome editing in human primary cells," Nat Biotechnol. 2015, 33(9):985-989.
Ibarra et al. "Targeted Killing of HIV Infected Cells Using CCR5-Disrupted Anti-HIV-CAR T Cells," Molecular Therapy, 2016, 24(Suppl 1): S301, Abstract 761.
Jinek et al. "A programmable dual-RNA-guided DNA endonuclease in adaptive bacterial immunity," Science. 2012 , 337(6096):816-21.
Ko et al., (2011) "Ten-Eleven-Translocation 2 (TET2) negatively regulates homeostasis and differentiation of hematopoietic stem cells in mice," PNAS 108(35): 14566-14571.
Lin et al. "Topical administration of orbital fat-derived stem cells promotes corneal tissue regeneration," Stem Cell Res Ther. 2013; 4(3):72.
Montague et al. "CHOPCHOP: a CRISPR/Cas9 and TALEN web tool for genome editing," Nucleic Acids Res. 2014, 42(Web Server issue):W401-7.
Myadelets "Part 1. Cytology, embryology and general histology" Histology, cytology and human embryology, textbook, Vitebsk:VSMU, 2014, p. 197.
Office Action issued in Russian Patent Application No. 2019133280/ 10(065730) dated Sep. 24, 2021, 10 pgs.
PCT International Search Report and Written Opinion of the International Searching Authority received in PCT/IB2019/059162, dated Jan. 21, 2020 (12 pgs.).
Perrin "Make Mouse Studies Work," Nature, Mar. 27, 2014;507(7493):423-5 Preclinical research: Make mouse studies work.
Qin et al. "Efficient CRISPR/Cas9-Mediated Genome Editing in Mice by Zygote Electroporation of Nuclease," Genetics, 2015, 200: 423-430.
Shaw et al. "Novel ROCK inhibitors for the treatment of pulmonary arterial hypertension," Bioorg Med Chem Lett. Oct. 15, 2014;24(20):4812-7. doi: 10.1016/j.bmcl.2014.09.002. Epub Sep. 6, 2014. PMID: 25248678.
Shrikant et al. "Regulating functional cell fates in CD8 T cells," Immunol. Res., 2010, 46: 12-22.
Tang et al. "A nanobody-based system using fluorescent proteins as scaffolds for cell-specific gene manipulation," Cell. 2013, 154: 1370-1379.
Wang et al. "One-step generation of mice carrying mutations in multiple genes by CRISPR/Cas-mediated genome engineering." Cell. May 9, 2013;153(4):910-8.

(56) References Cited

OTHER PUBLICATIONS

Wang et al., "Highly efficient homology-driven genome editing in human T cells by combining zinc-finger nuclease mRNA and AAV6 donor delivery," *Nucleic Acids Research*, 2016, 44(3): e30, 9 pages, available online Nov. 2, 2015.

Yang et al. "One-Step Generation of Mice Carrying Reporter and Conditional Alleles by CRISPR/Cas-Mediated Genome Engineering," *Cell*, 2013, 154: 1370-1379.

Yang et al., "Universal Corneal Epithelial-Like Cells Derived from Human Embryonic Stem Cells for Cellularization of a Corneal Scaffold", Transl Vis Sci Technol. Oct. 10, 2018;7(5):23 (16 pgs.).

Derksen et al. "Illegitimate WNT signaling promotes proliferation of multiple myeloma cells," PNAS, 2004, vol. 101 No. 16 p. 6122-6127.

Dirks. "Brain tumor stem cells: bringing order to the chaos of brain cancer," J Clin Oncol. Jun. 10, 2008;26(17):2916-24.

Internet Archive Wayback Machine, ChopChop, https://web.archive.org/web/20220000000000*/https://chopchop.rc.fas.harvard.edu, Feb. 5, 2015.

Kozhucharova "New Human Embryonic Stem Cell Lines C612 and C910," Cytology, 2009; 51(7):551-558, p. 551 [in Russian].

Labun et al. "CHOPCHOP v2: a web tool for the next generation of CRISPR genome engineering," Nucleic Acids Res. Jul. 8, 2016;44(W1):W272-6. doi: 10.1093/nar/gkw398. Epub May 16, 2016. PMID: 27185894; PMCID: PMC4987937.

Liang et al. "Rapid and highly efficient mammalian cell engineering via Cas9 protein transfection", J Biotechnol. Aug. 20, 2015;208:44-53.

Lopez-Lazaro "The migration ability of stem cells can explain the existence of cancer of unknown primary site. Rethinking metastasis," Oncoscience. May 1, 2015;2(5):467-75.

Menzorov et al. "What Collections of Cell Lines Are for," Vavilov Journal of Genetics and Selection, 2016; 20(6): 945-948; p. 947 [in Russian].

Menzorov, A.G.. "Murine and Human Embryonic Stem Cells," Vavilov Journal of Genetics and Selection, 2013; 17(2): 234-245 [in Russian].

Office Action issued in Russian Patent Application No. 2019133280/10(065730) dated Mar. 14, 2023, 26 pgs.

Office Action issued in Russian Patent Application No. 2019133280/10(065730) dated May 2, 2023, 15 pgs.

PCT International Search Report and Written Opinion of the International Searching Authority issued in PCT/IB2021/053413, dated Sep. 7, 2021, 13.

Tran et al. "Survival comparison between glioblastoma multiforme and other incurable cancers," J Clin Neurosci. Apr. 2010;17(4):417-21.

Vechkanov et al. "Foundations of Cell Engineering: a textbook"—Rostov-na-Donu, 2012; pp. 15, 16. [in Russian].

Wiles et al. "CRISPR-Cas9-mediated genome editing and guide RNA design. Mamm Genome," Oct. 2015;26(9-10):501-10. doi: 10.1007/s00335-015-9565-z. Epub May 20, 2015. PMID: 25991564; PMCID: PMC4602062.

Yangulov et al. "The Effect of Various Cryoprotective Media on the Viability of Cryopreserved Lymphoblastic Cell Lines H-9 and U-937," Problems of Cryobiology. 1991; 3: 46-49 [in Russian].

Zhdanov et al. "The Mystery of the Third Kingdom," Moscow, "Znanie", 1975-176 pages; pp. 124, 125 [in Russian].

\* cited by examiner

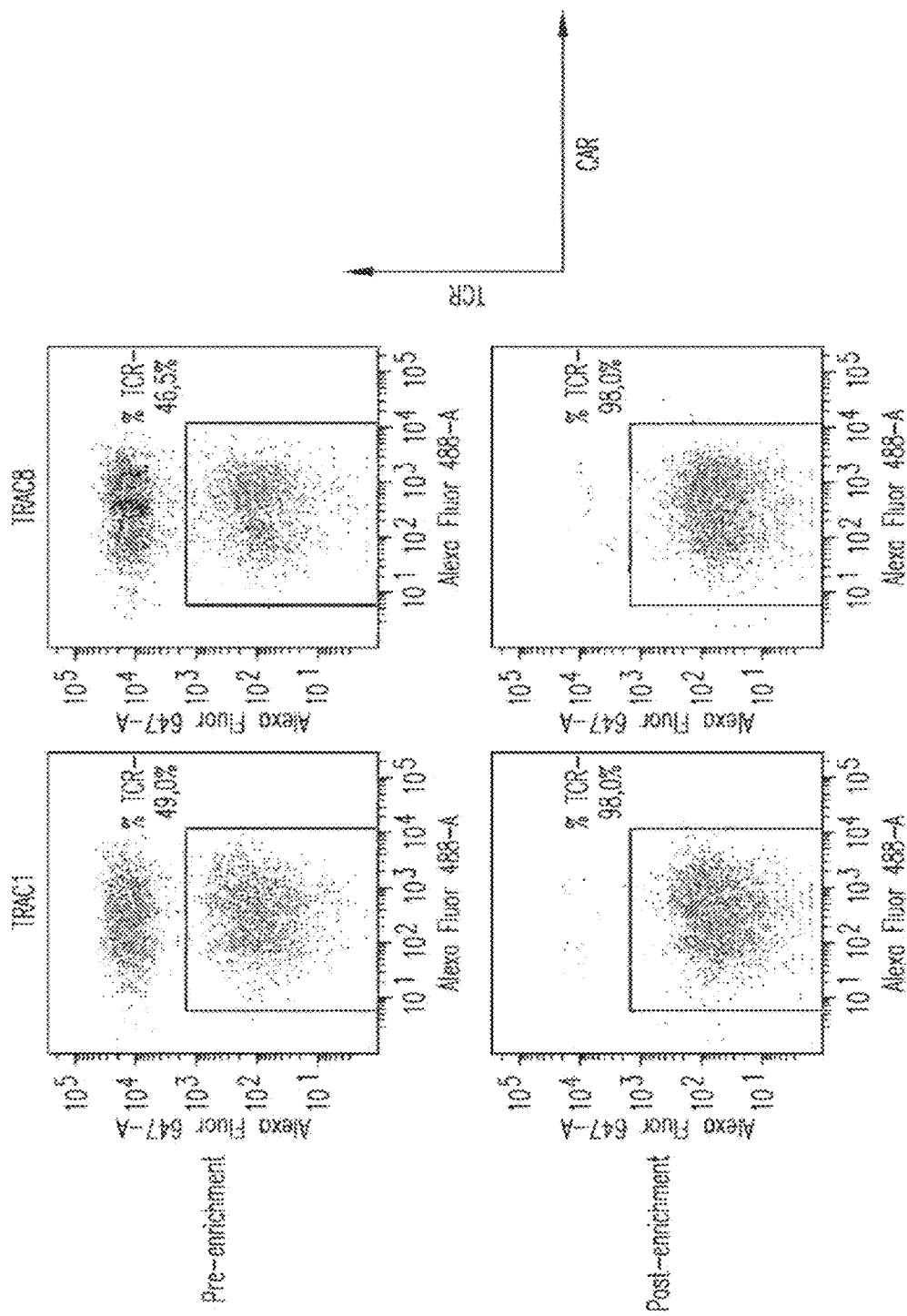

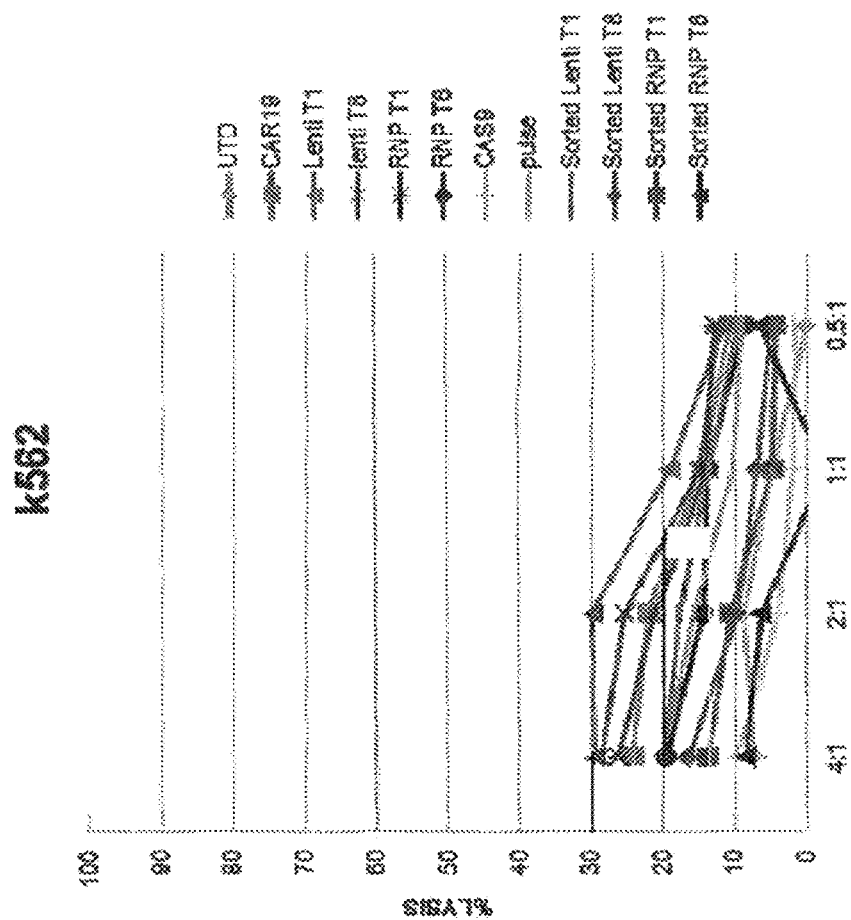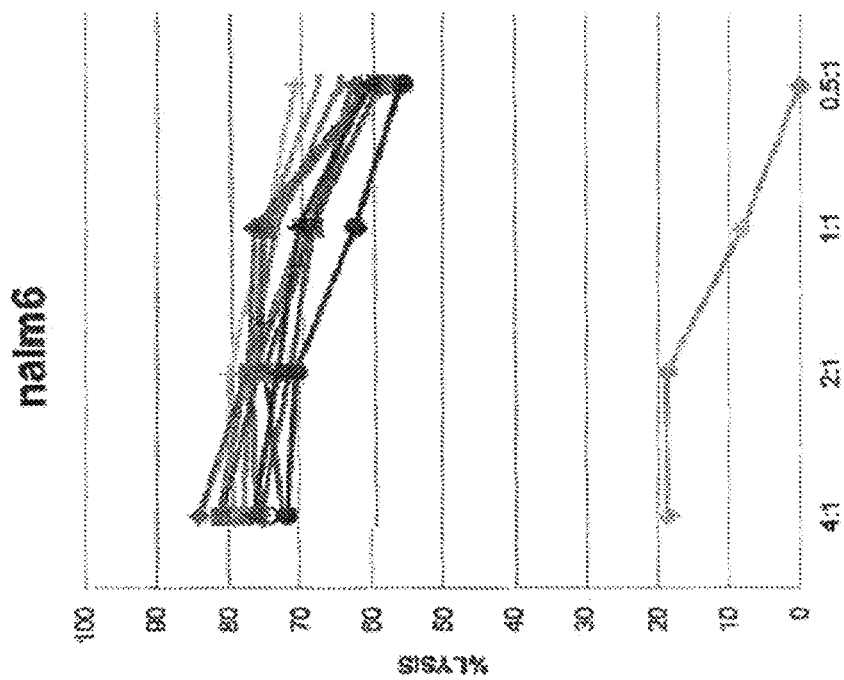
FIG. 7

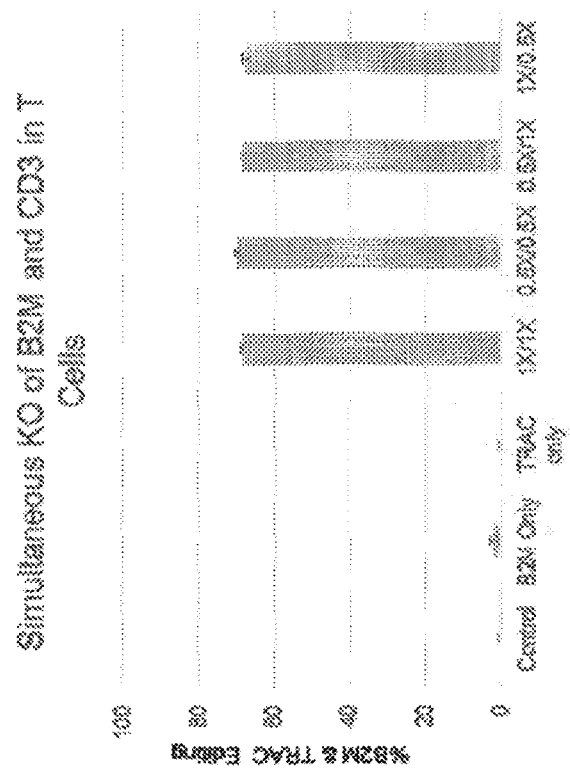

| gRNA ID | Species | Strand | Location | Avg % Edit | SD Edit | Editing Rank | Ave % PS | SD PS | PS rank |
|---|---|---|---|---|---|---|---|---|---|
| CR002077 | h | + | Chr20:1392999-1393020 | 82.22 | 5.96 | 1 | 76.13 | 4.34 | 1 |
| CR002097 | h | - | Chr20:1392846-1392868 | 74.27 | 3.87 | 4 | 67.97 | 3.89 | 2 |
| CR002096 | h | + | Chr20:1392847-1392869 | 63.30 | 3.03 | 8 | 58.53 | 2.29 | 3 |
| CR002064 | h | + | Chr20:1393053-1393075 | 64.65 | 7.97 | 7 | 56.80 | 6.85 | 4 |
| CR002091 | h | - | Chr20:1392880-1392902 | 78.42 | 2.47 | 2 | 56.20 | 2.70 | 5 |
| CR002057 | h | + | Chr20:1393117-1393139 | 61.01 | 2.06 | 9 | 51.13 | 2.00 | 6 |
| CR002100 | h | + | Chr20:1392814-1392836 | 56.42 | 0.99 | 11 | 49.20 | 0.96 | 7 |
| CR002113 | h | - | Chr20:1375513-1375535 | 50.51 | 5.97 | 17 | 46.47 | 5.85 | 8 |
| CR002056 | h | + | Chr20:1393118-1393140 | 51.26 | 0.23 | 16 | 45.73 | 0.89 | 9 |
| CR002078 | h | + | Chr20:1392995-1393017 | 56.06 | 5.91 | 13 | 45.70 | 4.44 | 10 |
| CR002068 | h | + | Chr20:1393039-1393061 | 60.55 | 7.79 | 5 | 44.70 | 4.09 | 11 |
| CR002104 | h | - | Chr20:1375565-1375587 | 55.58 | 4.38 | 14 | 43.87 | 5.22 | 12 |
| CR002070 | h | + | Chr20:1393018-1393040 | 59.50 | 8.10 | 10 | 43.17 | 4.19 | 13 |
| CR002086 | h | - | Chr20:1392907-1392929 | 52.13 | 4.69 | 15 | 42.63 | 2.94 | 14 |
| CR002063 | h | - | Chr20:1393057-1393079 | 77.18 | 3.99 | 3 | 42.43 | 1.37 | 15 |

FIG. 23

| gRNA ID | CD3+ T cells (NGS) | | | |
|---|---|---|---|---|
| | % Edit | Stdev | % FS edit | StDev |
| CR002100 | 50.3 | 2.3 | 46.1 | 2.3 |
| CR002097 | 46.0 | 4.5 | 38.7 | 4.5 |
| CR002091 | 51.2 | 7.9 | 35.7 | 7.9 |
| CR002085 | 39.5 | 7.1 | 30.4 | 7.1 |
| CR002086 | 33.6 | 1.9 | 29.3 | 1.9 |
| CR002089 | 40.2 | 1.9 | 28.3 | 1.9 |
| CR002088 | 33.8 | 2.4 | 26.2 | 2.4 |
| CR002096 | 23.8 | 3.0 | 22.3 | 3.0 |
| CR002095 | 29.1 | 4.0 | 20.1 | 4.0 |
| CR002080 | 29.7 | 7.5 | 18.9 | 1.5 |
| CR002109 | 25.2 | 3.4 | 16.4 | 3.4 |
| CR002112 | 21.8 | 0.7 | 15.7 | 0.7 |
| CR002110 | 15.3 | 1.4 | 13.6 | 1.4 |
| CR002108 | 19.2 | 1.4 | 13.7 | 1.4 |
| CR002104 | 18.2 | 0.7 | 13.1 | 0.7 |
| CR002115 | 16.3 | 1.8 | 12.4 | 1.8 |
| CR002116 | 10.2 | 0.2 | 8.6 | 0.2 |
| CR002087 | 12.5 | 0.6 | 8.3 | 0.6 |
| CR002107 | 8.7 | 0.6 | 5.9 | 0.6 |
| CR002113 | 6.3 | 0.7 | 5.3 | 0.7 |

FIG. 24

| Guide RNA | % indels (avg) Expt. 1 | % indels (avg) Expt. 2 | % frameshift edits (avg) Expt. 2 |
|---|---|---|---|
| CR000961 | 96.95 | 96.54 | 77.27 |
| CR000978 | 86.31 | 93.97 | 46.86 |
| CR000984 | 96.96 | | |
| CR000992 | 14.97 | 95.57 | 65.73 |
| CR000960 | 95.12 | | |
| CR000979 | 91.03 | | |
| CR000991 | | 96.65 | 52.14 |
| CR000993 | | 97.14 | 37.88 |

| Guide RNA | % indels (avg) | % frameshift edits (avg) |
|---|---|---|
| CR002961 | 91.38 | 86.88 |
| CR002965 | 92.49 | 75.36 |
| CR002967 | 99.24 | 87.58 |
| CR002972 | 88.41 | 84.76 |
| CR002976 | 90.40 | 81.85 |
| CR002980 | 88.81 | 27.07 |

| Guide RNA | % indels (avg) | % frameshift edits (avg) |
|---|---|---|
| CR002967 | 95.35 | 84.59 |
| CR002992 | 94.82 | 60.91 |
| CR002993 | 96.09 | 65.11 |
| CR003007 | 96.16 | 82.93 |

FIG. 43

| Guide-Treatment | Variant Read | Frequency (avg) | Avg (Indel Length) | Unique Concatenate (Call) |
|---|---|---|---|---|
| CR002967 | GCAGCTCACAGTGTGCCACCATGGAGTTGGGGCCCCTAGAAGGATGGCTACCTGGAGCTTCTTAACAGCGATGCTGACCCC | 38.70% | 1 | Frameshift |
| CR002967 | GCAGCTCACAGTGTGCCACCATGGAGTTGGAGTTGGGG---TAGAAGGTGGCTACCTGGAGCTTCTTAACAGCGATGCTGACCCC | 4.83% | -4 | Frameshift |
| CR002967 | GCAGCTCACAGTGTGCCACCATGGAGTTGGGGCCCCAGAAGGTGGCTACCTGGAGCTTCTTAACAGCGATGCTGACCCC | 2.66% | -1 | Frameshift |
| CR002967 | GCAGCTCACAGTGTGCCACCATGGAG------------------------------CTTCTTAACAGCGATGCTGACCC | 2.50% | -30 | In Frame |
| CR002967 | GCAGCTCACAGTGTGCCACCATGGAGTTGGGGC--------------TACCTGGAGCTTCTTAACAGCGATGCTGACCCC | 2.30% | -14 | Frameshift |
| CR002967 | GCAGCTCACAGTGTGCCACCATGGAGTTGGG-----TAGAAGGTGGCTACCTGGAGCTTCTTAACAGCGATGCTGACCCC | 2.01% | -5 | Frameshift |
| CR002967 | GCAGCTCACAGTGTGCCACCATGGAGTTGG----------------CTACCTGGAGCTTCTTAACAGGGATGCTGACCCC | 1.90% | -16 | Frameshift |
| CR002967 | GCAGCTCACAGTGTGCCACC-------------------------------TGGAGCTTCTTAACAGGGATGCTGACCCC | 1.85% | -31 | Frameshift |
| CR002967 | GCAGCTCACAGTGTGCCACCATGGAGTTGGGCACC-TAGAAGGCCC-TAGAAGGTGGCTACCTGGAGCTTCTTAACAGCGATGCTGACCCC | 1.82% | -1 | Frameshift |
| CR002992 | GCAGCAGGCTGTGTGTGTGACATGGAAGGTGATGAAGA-------AGAAGGTGGCTACCTGGGG | 1.81% | -5 | Frameshift |
| CR002992 | CAGCAGGCTGTGTGTGTGACATGGAAGGTGATGAAGA-ACCAGGGAGGCTTATGCCAATATCGGTGAGGAAGCACCTGAGC | 6.68% | -2 | Frameshift |
| CR002992 | CAGCAGGCTGTGTGTGTGACATGGAAGGTGATGAAGA--GAGGCTTATGCCAATATCGGTGAGGAAGCACCTGAGC | 4.03% | -1 | Frameshift |
| CR002992 | CAGCAGGCTGTGTTGTGTGACATGGAAGG------------GAGGCTTATGCCAATATCGGTGAGGAAGCACCTGAGC | 3.82% | -16 | Frameshift |
| CR002992 | CAGCAGGCTGTGTGTGTGACATGGACATGGAAGG--------GCTTATGCCAATATCGGTGAGGAAGCACCTGAGC | 3.36% | -9 | In Frame |
| CR002992 | CAGCAGGCTGTGTGTGTGACATGGAAGG-------------------CTTATGCCAATATCGGTGAGGAAGCACCTGAGC | 3.06% | -20 | Frameshift |
| CR002992 | CAGCAGGCTGTGTGTGTGACATGGAAGG-CAGGGAGGAG-CAGGGAGGCTTATGCCAATATCGGTGAGGAAGCACCTGAGC | 2.59% | -2 | Frameshift |
| CR002992 | CAGCAGGCTGTGTGTGTGACATGGAAGG-------GGAAGGCTTATGCCAATATCGGTGAGGAAGCACCTGAGC | 2.19% | -7 | Frameshift |
| CR002992 | CAGCAGGCTGTGTGTGTGACA-----------------------GGAAGCACCTGAGC | 2.04% | -21 | Frameshift |
| CR002993 | CAGCAGGCTGTGTGTGTGACATGGAAGGTGA--------------------CCAGGGAGGCTTATGCCAATATCGGTGAGGAAGCACCTGAGC | 2.02% | -38 | Frameshift |
| CR002993 | AGCAGGCTGTTGTGTGTGACATGGAAGGTGATGAATGAA----CCAGGGAGGCTTATGCCAATATCGGTGAGGAAGCACCTGAGC | 2.01% | -4 | Frameshift |
| CR002993 | AGCAGGCTGTTGTGTGTGACATGGAAGGTGATGAAGAGTGATGAAGA-ACCAGGGAGGCTTATGCCAATATCGGTGAGGAAGCACCTGAGCC | 16.80% | -1 | Frameshift |
| CR002993 | AGCAGGCTGTTGTGTGTGACATGGAAGGTGATGAAGAaCCAGGGAGGCTTATGCCAATATCGGTGAGGAAGCACCTGAGCC | 8.07% | 1 | Frameshift |
| CR002993 | AGCAGGCTGTTGTGTGTGACATGGAAGGTGA--------------------GGAAGCACCTGAGC | 4.44% | -38 | Frameshift |
| CR002993 | AGCAGGCTGTTGTGTGTGACATGGAAGGTGATG-------CCAATATCGGTGAGGAAGCACCTGAGCC | 3.00% | -20 | In Frame |
| CR002993 | AGCAGGCTGTTGTGTGTGACATGGAAGGTGATGAAGAG-------GCTTATGCCAATATCGGTGAGGAAGCACCTGAGCC | 2.77% | -21 | In Frame |
| CR002993 | AGCAGGCTGTTGTGTGTGACATGGAAGGTGATGAAGG-------GAGGCTTATGCCAATATCGGTGAGGAAGCACCTGAGCC | 2.71% | -9 | In Frame |
| CR002993 | AGCAGGCTGTTGTGTGTGACATGGAAGGTGAAGG----------GAGGCTTATGCCAATATCGGTGAGGAAGCACCTGAGCC | 2.48% | -10 | Frameshift |
| CR002993 | AGCAGGCTGTGTGTGTGACATGGAAGGTGATGAAGG--CCAGGGAGGCTTATGCCAATATCGGTGAGGAAGCACCTGAGCC | 2.15% | -2 | Frameshift |
| CR002993 | AGCAGGCTGTGTGTGTGACATGGAAGATGAAG---GGAGGCTTATGCCAATATCGGTGAGGAAGCACCTGAGCC | 1.97% | -7 | Frameshift |
| CR002993 | AGCAGGCTGTGTTGTGTGACATGGAAGGTGATGAAG------GGAGGCTTATGCCAATATCGGTGAGGAAGCACCTGAGCC | 1.77% | -7 | Frameshift |
| CR003007 | TTTTTCTCAAAGTAGAGCACATAGGACCAGATGA--GAGTATGGAGATGGAGTATCGGTGAGAGTGAGAGTATGGAGCAGAAGAAGTTGGGCAGAAA | 46.65% | 1 | Frameshift |
| CR003007 | TTTTTCTCAAAGTAGAGCACATAGGACCAGATGA-TGATCGGTGAGAGTGA-TGATCGGTGAGAGTGAGAGTATGCCAGCAGAAGAAGTTGGGCAGAAA | 4.85% | 6 | In Frame |
| CR003007 | TTTTTCTCAAAGTAGAGCACATAGGACCAGATGA--CGGTGAGAGTGAGAGTATGCCAGCAGAAGAAGTTGGGCAGAAA | 2.52% | -2 | Frameshift |
| CR003007 | TTTTTCTCAAAGTAGAGCACATAGGACCAGATGA--TCGGTGAGAGTATGGAGAGTGAGAGTATGCCAGCAGAAGAAGTTGGGCAGAAA | 2.28% | -5 | Frameshift |
| CR003007 | TTTTTCTCAAAGTAGAGCACATAGGACCAGATGA-------GAGTATGGAGATGGAGTATCGGTGAGAGTGAGAGTATGCCAGCAGAAGAAGTTGGGCAGAAA | 2.18% | -12 | In Frame |
| CR003007 | TTTTTCTCAAAGTAGAGCACATAGGACCAGATGA--ATCGGTGAGAGTATGCCAGCAGAAGAAGTTGGGCAGAAA | 1.64% | -2 | Frameshift |
| CR003007 | TTTTTCTCAAAGTAGAGCACATAGGACCAGATGA--GATGATCGGTGAGAGTATCGGAGAGTATGCCAGCAGAAGAAGTTGGGCAGAAA | 1.42% | -1 | Frameshift |
| CR003007 | TTTTTCTCAAAGTAGAGCACATAGGACCAGATG---TGATCGGTGAGAGTATGCCAGCAGAAGAAGTTGGGCAGAAA | 1.38% | -3 | In Frame |
| CR003007 | TTTTTCTCAAAGTAGAGCACATAGGACCAGATGA----TGATCGGTGAGAGTATGCCAGCAGAAGAAGTTGGGCAGAAA | 1.09% | -4 | Frameshift |
| CR003007 | TTTTTCTCAAAGTAGAGCACATAGGACCAGATGA---GATCGGTGAGAGTATGGAGAGTATGCCAGCAGAAGAAGTTGGGCAGAAA | 0.99% | -3 | In Frame |

FIG. 44

%indels (frameshifts)

| | Triple 1 | Triple 2 | Triple 3 | Triple 4 |
|---|---|---|---|---|
| B2M locus * | 92.71 (39.46) | 84.51 (38.33) | 84.75 (39.20) | 94.94 (39.16) |
| TRAC locus | 83.11 (74.95) | 83.89 (77.08) | 94.82 (78.85) | 96.08 (77.97) |
| CIITA locus | 80.59 (80.87) | 96.44 (83.63) | 90.78 (80.79) | 58.89 (40.69) |

FIG. 47

*Frameshift calculation for this guide does not include edits that alter or remove the start codon, so is an underestimate of disruptions of the coding sequence

| Guide RNA | % indels (avg) | % frameshift edits (avg) |
|---|---|---|
| CR002100 | 91.11 | 73.28 |
| CR002097 | 90.89 | 81.82 |
| CR002091 | 89.72 | 68.92 |
| CR002086 | 81.52 | 67.04 |
| CR002085 | 85.33 | 64.22 |

| Guide-Treatment | Variant Read | Indel frequency (avg) | Indel length (avg) | Unique Concatenate (Call) |
|---|---|---|---|---|
| CR002100 | CCCCTCCCGCTGGCCCCGACTCACCGGTGAGTGCACCACGCAGGTCTGGCGCGCT | 27.04% | 1 | Frameshift |
| CR002100 | CCCCTCCCCGCTGGGCCCCGGA-TCACGGTGAGTGCACCACGCAGGTCTGGCGCGCT | 5.77% | -1 | Frameshift |
| CR002100 | CCCCTCCCCGCTGGGCCCCGAC--ACCGGTGAGTGCACCACGCAGGTCTGGCGCGCT | 3.92% | -2 | Frameshift |
| CR002100 | CCCCTCCCCGCTGGGCCCCG--TCACGGTGAGTGCACCACGCAGGTCTGGCGCGCT | 3.59% | -2 | Frameshift |
| CR002100 | CCCCTCCCCG-------------GTGTAGTGCACCACGCAGGTCTGGCGCGCT | 3.31% | -19 | Frameshift |
| CR002097 | CTGGGCCCCGACTCACGGGTGTAGTGCACCACGCAAGGTCTGGCGCGCTTGGGGAAGGT | 59.62% | 1 | Frameshift |
| CR002097 | CTGGGCCCCGACTCACGGTGTAGTGCACCACGCA--CTGGCGCGCTTGGGGAAGGT | 2.24% | -3 | In Frame |
| CR002097 | CTGGGCCCCGACTCACGGTGTAGTGCACCACGCA----TGGCGCGCTTGGGGAAGGT | 1.94% | -4 | Frameshift |
| CR002097 | CTGGGCCCCGACTCACGGTGTAGTGCACCACGCA-TCTGGCGCGCTTGGGGAAGGT | 1.86% | -2 | Frameshift |
| CR002097 | CTGGGCCCCGACTCACGGTGTAGTGCACCACGC--------------TTGGGAAGGT | 1.47% | -14 | Frameshift |
| CR002091 | CAGGTCTGGCGCGCTTGGGGAAGGTGGGCCCTGAG-AGACAGAGAAGGGCATGCTGAGC | 40.37% | -1 | Frameshift |
| CR002091 | CAGGTCTGGCGCGCTTGGGGAAGGTGCGGCCCTGAGGAGGACAGAGAAGAGACGGGCATGCTGAGC | 9.41% | 1 | Frameshift |
| CR002091 | CTGGTCTGGCGCGCTTGGCGCGCTTGGGGAAGGTGCGCCCTGAG--ACAGAGACAGGGCATGCTGAGC | 7.55% | -3 | In Frame |
| CR002091 | CAGGTCTGGCGCGCTTGGGGAAGGTGCGCCCTG-GGAGACAGAGAAGGGCATGCTGAGC | 4.87% | -1 | Frameshift |
| CR002091 | CAGGTCTGGCGCGCTTGGGGAAGGTGGGCCCTGA--CAGAGACAGGGCATGCTGAGC | 1.61% | -5 | Frameshift |
| CR002086 | GAGCCGGCGCGGCGCACTACTCACGGTCTCCTGGG-AGATGGTTTCCACCTGCACTCCCA | 28.55% | -1 | Frameshift |
| CR002086 | GAGCCGGCGCGGCGCACTACTCACGGTCTCACGGTCTCCTGGG--ATGGTTTCCACCTGCACTCCCA | 5.26% | -3 | In Frame |
| CR002086 | GAGCCGGCGCGGCGCACTACTCACGGTCTCCTGGG--AGATGGTTTCCACCTGCACTCCCA | 4.68% | -2 | Frameshift |
| CR002086 | GAGCCGGCGCGGCGCACTACTCACGGTCTCCTG-------------TGCACTCCCA | 4.21% | -25 | Frameshift |
| CR002085 | GAGCCGGCGCGGCGCACTACTCACGGTCTCCTG-------CACTCCCA | 3.91% | -19 | Frameshift |
| CR002085 | GGGAGATGGTTTCCACCTGCACTC-ATGCGCGGGGGACGCTGAGCGGCGGGGCGGGGCG | 31.48% | -1 | Frameshift |
| CR002085 | GGGAGATGGTTTCCACCTGCACTC--ATGCGCGGGGGACGCTGAGCGGCGGGGCGGGCG | 6.10% | -2 | Frameshift |
| CR002085 | GGGAGATGGTTTCCACCTGCACTCCATGCGCGGGGGACGCTGAGCGGCGGGGCGGGCG | 4.66% | 0 | In Frame |
| CR002085 | GGGAGATGGTTTCCACCTGCAC--CCATGGCGCGGGGGACGCTGAGCGGCGGGGCGGGCG | 4.62% | -2 | Frameshift |
| CR002085 | GGGAGATGGTTTCCACCTGCAC---CATGCGCGGGCGCCGACGCTGAGCGGCGGGGCGGGCG | 1.70% | -3 | In Frame |

| gRNA Targeting Domain ID | Target | Species | % CD3-negative cells (Mean) | SD |
|---|---|---|---|---|
| CR005334 | CD3 delta | Human | 98.8 | 0.4 |
| CR005335 | CD3 delta | Human | 3.2 | 0.3 |
| CR005336 | CD3 delta | Human | 4.3 | 0.4 |
| CR005337 | CD3 delta | Human | 13.1 | 0.7 |
| CR005338 | CD3 delta | Human | 2.8 | 0.3 |
| CR005339 | CD3 delta | Human | 19.4 | 2.1 |
| CR005340 | CD3 delta | Human | 1.9 | 0.1 |
| CR005341 | CD3 delta | Human | 5.0 | 0.6 |
| CR005342 | CD3 delta | Human | 6.5 | 1.0 |
| CR005343 | CD3 delta | Human | 2.5 | 0.5 |
| CR005344 | CD3 delta | Human | 23.2 | 1.0 |
| CR005345 | CD3 delta | Human | 71.9 | 2.1 |
| CR005346 | CD3 delta | Human | 3.1 | 0.6 |
| CR005347 | CD3 delta | Human | 30.6 | 2.2 |
| CR005348 | CD3 delta | Human | 6.3 | 0.8 |

FIG. 65

| gRNA Targeting Domain ID | Target | Species | % CD3-negative cells (Mean) | SD |
|---|---|---|---|---|
| CR005349 | CD3 gamma | Human | 3.1 | 0.4 |
| CR005350 | CD3 gamma | Human | 2.6 | 0.6 |
| CR005351 | CD3 gamma | Human | 9.8 | 0.3 |
| CR005352 | CD3 gamma | Human | 3.6 | 0.6 |
| CR005353 | CD3 gamma | Human | 2.3 | 0.1 |
| CR005354 | CD3 gamma | Human | 8.8 | 0.2 |
| CR005355 | CD3 gamma | Human | 2.7 | 0.6 |
| CR005356 | CD3 gamma | Human | 27.9 | 2.9 |
| CR005357 | CD3 gamma | Human | 2.6 | 0.5 |
| CR005358 | CD3 gamma | Human | 2.2 | 0.2 |
| CR005359 | CD3 gamma | Human | 3.0 | 0.4 |
| CR005360 | CD3 gamma | Human | 2.5 | 0.7 |
| CR005361 | CD3 gamma | Human | 2.5 | 0.5 |
| CR005362 | CD3 gamma | Human | 17.7 | 0.8 |
| CR005363 | CD3 gamma | Human | 11.9 | 0.7 |

FIG. 66

COMPOSITIONS AND METHODS FOR IMMUNOONCOLOGY

RELATED APPLICATIONS

This application is a U.S. National Phase filing of the International Application Serial No. PCT/IB2016/057318 filed Dec. 2, 2016, which claims priority to U.S. Provisional patent application No. 62/263,169, filed Dec. 4, 2015, U.S. Provisional patent application No. 62/316,784, filed Apr. 1, 2016, and U.S. Provisional patent application No. 62/394,290, filed Sep. 14, 2016. The entire contents of these applications are incorporated herein by reference.

BACKGROUND

CRISPRs (Clustered Regularly Interspaced Short Palindromic Repeats) evolved in bacteria as an adaptive immune system to defend against viral attack. Upon exposure to a virus, short segments of viral DNA are integrated into the CRISPR locus of the bacterial genome. RNA is transcribed from a portion of the CRISPR locus that includes the viral sequence. That RNA, which contains sequence complimentary to the viral genome, mediates targeting of a Cas9 protein to the sequence in the viral genome. The Cas9 protein cleaves and thereby silences the viral target.

Recently, the CRISPR/Cas system has been adapted for genome editing in eukaryotic cells. The introduction of site-specific single (SSBs) or double strand breaks (DSBs) allows for target sequence alteration through, for example, non-homologous end-joining (NHEJ) or homology-directed repair (HDR).

SUMMARY OF THE INVENTION

The inventions described herein relate to compositions and methods for immunooncology, for example, cells modified at specific target sequences in their genome, including as modified by introduction of CRISPR systems that include gRNA molecules which target said target sequences, and methods of making and using therefore. For example, the present disclosure relates to gRNA molecules, CRISPR systems, cells, and methods useful for genome editing of cells, e.g., T cells, e.g., T-cells further engineered to express a chimeric antigen receptor, and useful for treating diseases such as cancers.

In a first aspect, the invention provides a gRNA molecule including a tracr and crRNA, wherein the crRNA includes a targeting domain that is complementary with a target sequence of an allogeneic T-cell target selected from B2M, CD247, CD3D, CD3E, CD3G, TRAC, TRBC1, TRBC2, HLA-A, HLA-B, HLA-C, DCK, CD52, FKBP1A, CIITA, NLRC5, RFXANK, RFX5, RFXAP, or NR3C1.

In embodiments of the gRNA molecule:
2(a) the allogeneic T-cell target is B2M, and the targeting domain includes any one of SEQ ID NO: 1 to SEQ ID NO: 83 or SEQ ID NO: 5492 to SEQ ID NO: 5527;
2(b) the allogeneic T-cell target is TRAC, and the targeting domain includes any one of SEQ ID NO: 5528 to SEQ ID NO: 5623 or SEQ ID NO: 5816 to SEQ ID NO: 5965;
2(c) the allogeneic T-cell target is TRBC1, and the targeting domain includes any one of SEQ ID NO: 5624 to SEQ ID NO: 5643 or SEQ ID NO: 5966 to SEQ ID NO: 6097;
2(d) the allogeneic T-cell target is TRBC2, and the targeting domain includes any one of SEQ ID NO: 5644 to SEQ ID NO: 5719 or SEQ ID NO: 6098 to SEQ ID NO: 6226;
2(e) the allogeneic T-cell target is CD247, and the targeting domain includes any one of SEQ ID NO: 84 to SEQ ID NO: 392;
2(f) the allogeneic T-cell target is CD3D, and the targeting domain includes any one of SEQ ID NO: 393 to SEQ ID NO: 532 or SEQ ID NO: 10780 to SEQ ID NO: 10794;
2(g) the allogeneic T-cell target is CD3E, and the targeting domain includes any one of SEQ ID NO: 533 to SEQ ID NO: 839 or SEQ ID NO: 10677 to SEQ ID NO: 10764;
2(h) the allogeneic T-cell target is CD3G, and the targeting domain includes any one of SEQ ID NO: 840 to SEQ ID NO: 968 or SEQ ID NO: 10765 to SEQ ID NO: 10779;
2(i) the allogeneic T-cell target is HLA-A, and the targeting domain includes any one of SEQ ID NO: 969 to SEQ ID NO: 1345;
2(j) the allogeneic T-cell target is MLA-B, and the targeting domain includes any one of SEQ ID NO: 1346 to SEQ ID NO: 1698;
2(k) the allogeneic T-cell target is HLA-C, and the targeting domain includes any one of SEQ ID NO: 1699 to SEQ ID NO: 2068;
2(l) the allogeneic T-cell target is DCK, and the targeting domain includes any one of SEQ ID NO: 5278 to SEQ ID NO: 5491;
2(m) the allogeneic T-cell target is CD52, and the targeting domain includes any one of SEQ ID NO: 6227 to SEQ ID NO: 6324;
2(n) the allogeneic T-cell target is FKBP1A, and the targeting domain includes any one of SEQ ID NO: 6325 to SEQ ID NO: 6583 or SEQ ID NO: 6662 to SEQ ID NO: 6749;
2(o) the allogeneic T-cell target is NR3C1, and the targeting domain includes any one of SEQ ID NO: 2069 to SEQ ID NO: 2941;
2(p) the allogeneic T-cell target is CIITA, and the targeting domain includes any one of SEQ ID NO: 6750 to SEQ ID NO: 7716 or SEQ ID NO: 7717 to SEQ ID NO: 7804; or
2(q) the allogeneic T-cell target is NLRC5, and the targeting domain includes any one of SEQ ID NO: 8622 to SEQ ID NO: 10089.

In embodiments of the gRNA molecule, the allogeneic T-cell target is TRAC, and the targeting domain includes SEQ ID NO: 5569, SEQ ID NO: 5585, SEQ ID NO: 5587, SEQ ID NO: 5592, SEQ ID NO: 5601, SEQ ID NO: 5589, SEQ ID NO: 5600, SEQ ID NO: 5594, SEQ ID NO: 5571, SEQ ID NO: 5593, SEQ ID NO: 5574, SEQ ID NO: 5598, SEQ ID NO: 5586, SEQ ID NO: 5599, SEQ ID NO: 5591, SEQ ID NO: 5610, SEQ ID NO: 5608, SEQ ID NO: 5617, SEQ ID NO: 5619, or SEQ ID NO: 5620, for example, the targeting domain includes SEQ ID NO: 5569, SEQ ID NO: 5586, SEQ ID NO: 5587, SEQ ID NO: 5592, SEQ ID NO: 5599, or SEQ ID NO: 5600, for example, targeting domain includes SEQ ID NO: 5569, SEQ ID NO: 5587, SEQ ID NO: 5592 or SEQ ID NO: 5586, for example, the targeting domain includes SEQ ID NO: 5569.

In embodiments of the gRNA molecule, the allogeneic T-cell target is TRBC2, and the targeting domain includes SEQ ID NO: 5719, SEQ ID NO: 5694, SEQ ID NO: 5706, SEQ ID NO: 5696, SEQ ID NO: 5711, SEQ ID NO: 5708, SEQ ID NO: 5709, SEQ ID NO: 5712, SEQ ID NO: 5703, SEQ ID NO: 5707, SEQ ID NO: 5687, SEQ ID NO: 5705, SEQ ID NO: 5713, SEQ ID NO: 5715, or SEQ ID NO: 5710.

In embodiments of the gRNA molecule, the allogeneic T-cell target is B2M, and the targeting domain includes SEQ ID NO: 5519, SEQ ID NO: 5497, SEQ ID NO: 5499, SEQ ID NO: 5498, SEQ ID NO: 5503, SEQ ID NO: 5496, SEQ ID NO: 5507, SEQ ID NO: 5515, SEQ ID NO: 5493, SEQ ID NO: 5506, SEQ ID NO: 5509, SEQ ID NO: 5517, SEQ ID NO: 5521, SEQ ID NO: 5520, SEQ ID NO: 5500, SEQ ID NO: 5494, SEQ ID NO: 5508, SEQ ID NO: 5514, or SEQ ID NO: 5492, for example, the targeting domain includes SEQ ID NO: 5496, SEQ ID NO: 5498, or SEQ ID NO: 5509.

In embodiments of the gRNA molecule, the allogeneic T-cell target is CIITA, and the targeting domain includes SEQ ID NO: 7771, SEQ ID NO: 7769, SEQ ID NO: 7773, SEQ ID NO: 7726, SEQ ID NO: 7758, SEQ ID NO: 7739, SEQ ID NO: 7779, SEQ ID NO: 7770, SEQ ID NO: 7749, SEQ ID NO: 7754, SEQ ID NO: 7745, SEQ ID NO: 7785, SEQ ID NO: 7731, SEQ ID NO: 7772, SEQ ID NO: 7743, or SEQ ID NO: 7750, for example, the targeting domain includes SEQ ID NO: 7769, SEQ ID NO: 7771, SEQ ID NO: 7739, or SEQ ID NO: 7785.

In embodiments of the gRNA molecule, the allogeneic T-cell target is CD3E, and the targeting domain includes SEQ ID NO: 10729, SEQ ID NO: 10719, SEQ ID NO: 10764, SEQ ID NO: 10789, SEQ ID NO: 10701, SEQ ID NO: 10700, or SEQ ID NO: 10722.

In embodiments of the gRNA molecule, the allogeneic T-cell target is FKBP1A, and the targeting domain includes SEQ ID NO: 6693, SEQ ID NO: 6705, SEQ ID NO: 6694, SEQ ID NO: 6708, or SEQ ID NO: 6699.

In a second aspect, the invention provides a gRNA molecule including a tracr and crRNA, wherein the crRNA includes a targeting domain that is complementary with a target sequence of an inhibitory molecule or downstream effector of signaling through an inhibitory molecule selected from CD274, HAVCR2, LAG3, PDCD1, PD-L2, CTLA4, CEACAM (e.g., CEACAM-1, CEACAM-3 and/or CEACAM-5), VISTA, BTLA, TIGIT, LAIR1, CD160, 2B4, CD80, CD86, B7-H3 (CD113), B7-H4 (VTCN1), HVEM (TNERSF14 or CD107), K1R, A2aR, MHC class I, MHC class II, GAL9, adenosine, and TGF beta, or PTPN11.

In embodiments of the gRNA molecule:
15(a) the inhibitory molecule is CD274 (PD-L1), and the targeting domain includes any one of SEQ ID NO: 2942 to SEQ ID NO: 3270;
15(b) the inhibitory molecule is HAVCR2 (TIM3), and the targeting domain includes any one of SEQ ID NO: 3271 to SEQ ID NO: 3541;
15(c) the inhibitory molecule is LAG3, and the targeting domain includes any one of SEQ ID NO: 3542 to SEQ ID NO: 4032;
15(d) the inhibitory molecule is PDCD1 (PD-1), and the targeting domain includes any one of SEQ ID NO: 4033 to SEQ ID NO: 4589 or SEQ ID NO: 5720 to SEQ ID NO: 5815; or
15(e) the downstream effector of signaling through an inhibitory molecule is PTPN1, and the targeting domain includes any one of SEQ ID NO: 4590 to SEQ ID NO: 5277.

In embodiments of the gRNA molecule, the inhibitory molecule is PDCD1, and the targeting domain includes SEQ ID NO: 5743, SEQ ID NO: 5798, SEQ ID NO: 5748, SEQ ID NO: 5722, SEQ ID NO: 5800, SEQ ID NO: 5735, SEQ ID NO: 5724, SEQ ID NO: 5731, SEQ ID NO: 5725, SEQ ID NO: 5775, SEQ ID NO: 5766, SEQ ID NO: 5727, SEQ ID NO: 5744, SEQ ID NO: 5751, or SEQ ID NO: 5734, for example, the targeting domain includes SEQ ID NO: 5775.

In embodiments of the gRNA molecule, including in any of the aforementioned aspects and embodiments, the targeting domain includes 17, 18, 19, 20, 21 (if present in the reference sequence), 22 (if present in the reference sequence), 23 (if present in the reference sequence), 24 (if present in the reference sequence), or 25 (if present in the reference sequence) consecutive nucleic acids of any one of the recited targeting domain sequences. In other embodiments of the gRNA molecule, including in any of the aforementioned aspects and embodiments, the targeting domain consists of 17, 18, 19, 20, 21 (if present in the reference sequence), 22 (if present in the reference sequence), 23 (if present in the reference sequence), or 24 (if present in the reference sequence), or 25 (if present in the reference sequence) consecutive nucleic acids of any one of the recited targeting domain sequences. In embodiments of the gRNA molecule, including in any of the aforementioned aspects and embodiments, the 17, 18, 19, 20, 21 (if present in the reference sequence), 22 (if present in the reference sequence), 23 (if present in the reference sequence), or 24 (if present in the reference sequence), or 25 (if present in the reference sequence) consecutive nucleic acids of any one of the recited targeting domain sequences are the 17, 18, 19, 20, 21 (if present in the reference sequence), 22 (if present in the reference sequence), 23 (if present in the reference sequence), or 24 (if present in the reference sequence), or 25 (if present in the reference sequence) consecutive nucleic acids disposed at the 3' end of the recited targeting domain sequence. In other embodiments of the gRNA molecule, including in any of the aforementioned aspects and embodiments, the 17, 18, 19, 20, 21 (if present in the reference sequence), 22 (if present in the reference sequence), 23 (if present in the reference sequence), or 24 (if present in the reference sequence), or 25 (if present in the reference sequence) consecutive nucleic acids of any one of the recited targeting domain sequences are the 17, 18, 19, 20, 21 (if present in the reference sequence), 22 (if present in the reference sequence), 23 (if present in the reference sequence), or 24 (if present in the reference sequence), or 25 (if present in the reference sequence) consecutive nucleic acids disposed at the 5' end of the recited targeting domain sequence. In other embodiments of the gRNA molecule, including in any of the aforementioned aspects and embodiments, the 17, 18, 19, 20, 21 (if present in the reference sequence), 22 (if present in the reference sequence), 23 (if present in the reference sequence), or 24 (if present in the reference sequence), or 25 (if present in the reference sequence) consecutive nucleic acids of any one of the recited targeting domain sequences do not include either the 5' or 3' nucleic acid of the recited targeting domain sequence.

In embodiments of the gRNA molecule, including in any of the aforementioned aspects and embodiments, the targeting domain consists of the recited targeting domain sequence.

The following general aspects of the gRNA molecule may be combined, alone or in combination, with any of the gRNAs comprising a targeting domain described herein, for example, a targeting domain recited in any of the aforementioned aspects and embodiments.

In embodiments of the gRNA molecule, including in any of the aforementioned aspects and embodiments, a portion of the crRNA and a portion of the tracr hybridize to form a flagpole including SEQ ID NO: 6584 or SEQ ID NO: 6585. In other embodiments, the flagpole further includes a first flagpole extension, located 3' to the crRNA portion of the flagpole, wherein said first flagpole extension includes SEQ ID NO: 6586. In other embodiments, the flagpole further includes a second flagpole extension located 3' to the crRNA portion of the flagpole and, if present, the first flagpole extension, wherein said second flagpole extension includes SEQ ID NO: 6587.

In embodiments of the gRNA molecule, including in any of the aforementioned aspects and embodiments, the tracr includes, for example, consists of:
  (a) SEQ ID NO: 7820, optionally further including, at the 3' end, an additional 1, 2, 3, 4, 5, 6, or 7 uracil (U) nucleotides;
  (b) SEQ ID NO: 6660; or
  (c) SEQ ID NO: 6661. In such embodiments, the crRNA portion of the flagpole includes SEQ ID NO: 6607 or SEQ ID NO: 6608.

In embodiments of the gRNA molecule, including in any of the aforementioned aspects and embodiments, the tracr includes SEQ ID NO: 6589 or SEQ ID NO: 6590, and optionally, if a first flagpole extension is present, a first tracr extension, disposed 5' to SEQ ID NO: 6589 or SEQ ID NO: 6590, said first tracr extension including SEQ ID NO: 6591.

In embodiments of the gRNA molecule, including in any of the aforementioned aspects and embodiments, the targeting domain and the tracr are disposed on separate nucleic acid molecules.

In embodiments of the gRNA molecule, including in any of the aforementioned aspects and embodiments, the crRNA includes (for example, consists of), from 5' to 3', [targeting domain]—:
  a) SEQ ID NO: 6584;
  b) SEQ ID NO: 6585;
  c) SEQ ID NO: 6605;
  d) SEQ ID NO: 6606;
  e) SEQ ID NO: 6607;
  f) SEQ ID NO: 6608; or
  g) SEQ ID NO: 7806.

In embodiments of the gRNA molecule, including in any of the aforementioned aspects and embodiments, the tracr includes (for example, consists of), from 5' to 3':
  a) SEQ ID NO: 6589;
  b) SEQ ID NO: 6590;
  c) SEQ ID NO: 6609;
  d) SEQ ID NO: 6610;
  e) SEQ ID NO: 6660;
  f) SEQ ID NO: 6661;
  g) SEQ ID NO: 7820;
  h) SEQ ID NO: 7807;
  i) SEQ ID NO: 7808;
  j) SEQ ID NO: 7809;
  k) any of a) to j), above, further including, at the 3' end, at least 1, 2, 3, 4, 5, 6 or 7 uracil (U) nucleotides, e.g., 1, 2, 3, 4, 5, 6, or 7 uracil (U) nucleotides;
  l) any of a) to k), above, further including, at the 3' end, at least 1, 2, 3, 4, 5, 6 or 7 adenine (A) nucleotides, e.g., 1, 2, 3, 4, 5, 6, or 7 adenine (A) nucleotides; or
  m) any of a) to l), above, further including, at the 5' end (e.g., at the 5' terminus), at least 1, 2, 3, 4, 5, 6 or 7 adenine (A) nucleotides, e.g., 1, 2, 3, 4, 5, 6, or 7 adenine (A) nucleotides.

In preferred embodiments of the gRNA molecule, including in any of the aforementioned aspects and embodiments, the targeting domain and the tracr are disposed on separate nucleic acid molecules, and the nucleic acid molecule including the targeting domain includes SEQ ID NO: 6607, optionally disposed immediately 3' to the targeting domain, and the nucleic acid molecule including the tracr includes, e.g., consists of, SEQ ID NO: 6660.

In other embodiments of the gRNA molecule, including in any of the aforementioned aspects and embodiments, the targeting domain and the tracr are disposed on a single nucleic acid molecule, and wherein the tracr is disposed 3' to the targeting domain. In such embodiments of the gRNA molecule, including in any of the aforementioned aspects and embodiments, the gRNA molecule further includes a loop, disposed 3' to the targeting domain and 5' to the tracr, for example, a loop that includes (for example, consists of) SEQ ID NO: 6588.

In embodiments of the gRNA molecule, including in any of the aforementioned aspects and embodiments, the gRNA molecule includes (for example, consists of), from 5' to 3', [targeting domain]—:
  (a) SEQ ID NO: 6601;
  (b) SEQ ID NO: 6602;
  (c) SEQ ID NO: 6603;
  (d) SEQ ID NO: 6604;
  (e) SEQ ID NO: 7811; or
  (f) any of (a) to (e), above, further including, at the 3' end, 1, 2, 3, 4, 5, 6 or 7 uracil (U) nucleotides.

In preferred embodiments of the gRNA molecule, including in any of the aforementioned aspects and embodiments, the targeting domain and the tracr are disposed on a single nucleic acid molecule, and wherein said nucleic acid molecule includes, e.g., consists of, said targeting domain and SEQ ID NO: 6601, optionally disposed immediately 3' to said targeting domain.

In preferred embodiments of the gRNA molecule, including in any of the aforementioned aspects and embodiments, the targeting domain and the tracr are disposed on a single nucleic acid molecule, and wherein said nucleic acid molecule includes, e.g., consists of, said targeting domain and SEQ ID NO: 7811, optionally disposed immediately 3' to said targeting domain.

In embodiments, the gRNA molecule consists of unmodified RNA nucleotides and nucleic acid bonds. In other embodiments, the gRNA molecule contains one or more modifications, for example as described herein. In embodiments of the gRNA molecule, including in any of the aforementioned aspects and embodiments, one, or optionally more than one, of the nucleic acid molecules of the gRNA molecule includes:
  a) a, e.g., three, phosphorothioate modification(s) at the 3' end of said nucleic acid molecule or molecules;
  b) a, e.g., three, phosphorothioate modification(s) at the 5' end of said nucleic acid molecule or molecules;
  c) a, e.g., three, 2'-O-methyl modification(s) at the 3' end of said nucleic acid molecule or molecules;
  d) a, e.g., three, 2'-O-methyl modification(s) at the 5' end of said nucleic acid molecule or molecules;
  e) a 2' O-methyl modification at each of the $4^{th}$-to-terminal, $3^{rd}$-to-terminal, and $2^{nd}$-to-terminal 3' residues of said nucleic acid molecule or molecules; or
  f) any combination thereof.

In embodiments of the gRNA molecule, including in any of the aforementioned aspects and embodiments, when a CRISPR system (e.g., an RNP as described herein, e.g., an RNP that includes a Cas9 molecule, for example as described herein) including the gRNA molecule (e.g., as described herein) is introduced into a cell, an indel is formed at or near the target sequence complementary to the targeting domain of the gRNA molecule. In embodiments, the indel is a frameshift mutation. In embodiments, the indel is an indel listed in any of FIG. 34A, FIG. 34B, FIG. 36, FIG. 38, FIG. 41, FIG. 44, FIG. 48, FIG. 49, FIG. 50 or FIG. 53.

In embodiments of the gRNA molecule, including in any of the aforementioned aspects and embodiments, when a CRISPR system (e.g., an RNP as described herein, e.g., an RNP that includes a Cas9 molecule, for example as described herein) including the gRNA molecule (e.g., as described herein) is introduced into a population of cells, an indel is formed at or near the target sequence complementary to the targeting domain of the gRNA molecule in at least about 40%, e.g., at least about 50%, e.g., at least about 60%, e.g., at least about 70%, e.g., at least about 80%, e.g., at least about 90%, e.g., at least about 95%, e.g., at least about 96%, e.g., at least about 97%, e.g., at least about 98%, e.g., at least about 99%, of the cells of the population. In embodiments, an indel that is a frameshift mutation is formed at or near the target sequence complementary to the targeting domain of the gRNA molecule in at least about 20%, e.g., at least about 30%, e.g., at least about 35%, e.g., at least about 40%, e.g., at least about 45%, e.g., at least about 50%, e.g., at least about 55%, e.g., at least about 60%, e.g., at least about 65%, e.g., at least about 70%, e.g., at least about 75%, e.g., at least about 80%, e.g., at least about 85%, e.g., at least about 90%, e.g., at least about 95%, e.g., at least about 99%, of the cells of the population. In embodiments, in at least about 30%, e.g., least about 40%, e.g., at least about 50%, e.g., at least about 60%, e.g., at least about 70%, e.g., at least about 80%, e.g., at least about 90%, e.g., at least about 95%, e.g., at least about 96%, e.g., at least about 97%, e.g., at least about 98%, e.g., at least about 99%, of the cells of the population, the indel is an indel listed in any of FIG. 34A, FIG. 34B, FIG. 36, FIG. 38, FIG. 41, FIG. 44, FIG. 48, FIG. 49, FIG. 50 or FIG. 53. In embodiments, the five most frequently detected indels in said population of cells include three or more, e.g., four, e.g., five, of the indels associated with any gRNA listed in any of FIG. 34A, FIG. 34B, FIG. 36, FIG. 38, FIG. 41, FIG. 44, FIG. 48, FIG. 49, FIG. 50 or FIG. 53. The indel or indel pattern is as measured and/or quantitated by, for example, next generation sequencing (NGS).

In embodiments of the gRNA molecule, including in any of the aforementioned aspects and embodiments, when a CRISPR system (e.g., an RNP as described herein, e.g., an RNP that includes a Cas9 molecule, for example as described herein) including the gRNA molecule (e.g., as described herein) is introduced into a cell (or population of cells) as described herein, expression of the gene including the target sequence complementary to the targeting domain of the gRNA molecule is reduced or eliminated in said cell. In embodiments, expression of said gene is reduced or eliminated in at least about 40%, e.g., at least about 50%, e.g., at least about 60%, e.g., at least about 70%, e.g., at least about 80%, e.g., at least about 90%, e.g., at least about 95%, e.g., at least about 96%, e.g., at least about 97%, e.g., at least about 98%, e.g., at least about 99%, of the cells of the population. In embodiments, the reduced or eliminated expression is measured by flow cytometry. In other embodiments, for example, in the case of FKBP1A, reduced or eliminated expression is measured by a functional assay, for example as described herein.

In embodiments of the gRNA molecule, including in any of the aforementioned aspects and embodiments, when a CRISPR system (e.g., an RNP as described herein, e.g., an RNP that includes a Cas9 molecule, for example as described herein) including the gRNA molecule (e.g., as described herein) is introduced into a cell as described herein, no off-target indels are formed in said cell, e.g., as detectable by next generation sequencing and/or a nucleotide insertional assay, for example as described herein.

In embodiments of the gRNA molecule, including in any of the aforementioned aspects and embodiments, when a CRISPR system (e.g., an RNP as described herein, e.g., an RNP that includes a Cas9 molecule, for example as described herein) including the gRNA molecule (e.g., as described herein) is introduced into a population of cells as described herein, an off-target indel is detected in no more than about 5%, e.g., no more than about 1%, e.g., no more than about 0.1%, e.g., no more than about 0.01%, of the cells of the population of cells e.g., as detectable by next generation sequencing and/or a nucleotide insertional assay.

In any of the aforementioned aspects and embodiments reciting a cell, the cell is (or population of cells includes) a mammalian, primate, or human cell, e.g., is a human cell. In any of the aforementioned aspects and embodiments reciting a cell, the cell is (or population of cells includes) an immune effector cell, for example, a T cell or NK cell, e.g., is a T cell, for example, a CD4+ T cell, a CD8+ T cell, or a combination thereof.

In any of the aforementioned aspects and embodiments reciting a cell, the cell (or population of cells) has been, or will be, engineered to express a chimeric antigen receptor (CAR). In embodiments, the CAR is:
(a) a CD19 CAR; or
(b) a BCMA CAR. In embodiments:
(a) the CAR is a CD19 CAR including an antigen binding domain including any one of SEQ ID NO: 7883 to SEQ ID NO: 7898;
(b) the CAR is a CD19 CAR including SEQ ID NO: 7909 or SEQ ID NO: 7920;
(c) the CAR is a BCMA CAR including an antigen binding domain including any one of SEQ ID NO: 7939 to SEQ ID NO: 8112, e.g., including an antigen binding domain of SEQ ID NO: 7949; or
(d) the CAR is a BCMA CAR including any one of SEQ ID NO: 8549 to SEQ ID NO: 8621, e.g., including SEQ ID NO: 8559.

In any of the aforementioned aspects and embodiments reciting a cell, the cell is allogeneic with respect to a patient to be administered said cell. In other embodiments, the cell is autologous with respect to a patient to be administered said cell.

In another aspect, the invention provides a composition including a first gRNA molecule of any of the previous aspects and embodiments, further including a Cas9 molecule. In embodiments, the Cas9 molecule includes, e.g., consists of, any one of SEQ ID NO: 6611 or SEQ ID NO: 7821 to SEQ ID NO: 7831. In embodiments, the Cas9 molecule is an active or inactive *S. pyogenes* Cas9. In preferred embodiments, the first gRNA molecule and Cas9 molecule are present in a ribonuclear protein complex (RNP).

In aspects, the composition may include more than one gRNA molecule, for example, more than one gRNA molecule, each of which is complexed with a Cas9 molecule described herein. For example, in embodiments, the composition further includes a second gRNA molecule; a second gRNA molecule and a third gRNA molecule; or a second gRNA molecule, a third gRNA molecule, and a fourth gRNA molecule, wherein the second gRNA molecule, the third gRNA molecule (if present), and the fourth gRNA molecule (if present) are a gRNA molecule as described herein, for example, a gRNA molecule of any of the previous aspects and embodiments, and wherein each gRNA molecule of the composition is complementary to a different target sequence (i.e., comprises a different targeting domain). In embodiments, the first gRNA molecule, the second gRNA molecule, the third gRNA molecule (if present), and the fourth gRNA molecule (if present) are complementary to target sequences within the same gene. In such embodiments, the first gRNA molecule, the second gRNA molecule, the third gRNA molecule (if present), and the fourth gRNA molecule (if present) are complementary to target sequences not more than 20000 nucleotides, not more than 10000 nucleotides, not more than 6000, not more than 5000 nucleotides, not more than 4000, not more than 1000 nucleotides, not more than 500 nucleotides, not more than 400 nucleotides, not more than 300 nucleotides, not more than 200 nucleotides, not more than 100 nucleotides, not more than 90 nucleotides, not more than 80 nucleotides, not more than 70 nucleotides, not more than 60 nucleotides, not more than 50 nucleotides, not more than 40 nucleotides, not more than 30 nucleotides, not more than 20 nucleotides or not more than 10 nucleotides apart. In other embodiments the first gRNA molecule, the second gRNA molecule, the third gRNA molecule (if present), and the fourth gRNA molecule (if present) are complementary to target sequence within different genes or loci, for example, different genes as described herein.

In embodiments, the first gRNA molecule is the gRNA molecule of any of 2(b), 2(c), 2(d), 2(d), 2(e), 2(f), 2(g) or 2(h); and the second gRNA molecule is the gRNA molecule of any of 2(a), 2(i), 2(j), 2(k) or 2(q); and the third gRNA molecule is the gRNA molecule of any of 15(a), 15(b), 15(c), 15(d), or 15(e). In other embodiments, the first gRNA molecule is the gRNA molecule of any of 2(b), 2(c), 2(d), 2(d), 2(e), 2(f), 2(g) or 2(h); and the second gRNA molecule is the gRNA molecule of any of 2(l), 2(m), 2(n), or 2(o); and the third gRNA molecule is the gRNA molecule of any of 15(a), 15(b), 15(c), 15(d), or 15(e). In other embodiments, the first gRNA molecule is the gRNA molecule of any of 2(b), 2(c), 2(d), 2(d), 2(e), 2(f), 2(g) or 2(h); and the second gRNA molecule is the gRNA molecule of any of 2(l), 2(m), 2(n), or 2(o). In other embodiments, the first gRNA molecule is the gRNA molecule of any of 2(b), 2(c), 2(d), 2(d), 2(e), 2(f), 2(g) or 2(h); and the second gRNA molecule is the gRNA molecule of any of 2(a), 2(i), 2(j), or 2(k). In other embodiments, the first gRNA molecule is the gRNA molecule of any of 2(b), 2(c), 2(d), 2(d), 2(e), 2(f), 2(g) or 2(h); and the second gRNA molecule is the gRNA molecule of any of 15(a), 15(b), 15(c), 15(d), or 15(e). In other embodiments, first gRNA molecule is the gRNA molecule of any of 15(a), 15(b), 15(c), 15(d), or 7(e); and the second gRNA molecule is the gRNA molecule of any of 15(a), 15(b), 15(c), 15(d), or 15(e). In embodiments of any of the aforementioned embodiments, a third gRNA is present, and the third gRNA molecule is a gRNA molecule of any of 15(a), 15(b), 15(c), 15(d), or 15(e). In embodiments, the composition consists of two gRNA molecules of any of the aforementioned gRNA molecule aspects and embodiments. In embodiments, the composition consists of three gRNA molecules of any of the aforementioned gRNA molecule aspects and embodiments. In embodiments, the composition consists of a first gRNA molecule of any of the aforementioned aspects and embodiments, wherein the targeting domain of said first gRNA molecule is a targeting domain of any of 2(a), 2(i), 2(j), or 2(k); and a second gRNA molecule of any of the aforementioned gRNA molecule aspects and embodiments, wherein the targeting domain of said second gRNA molecule is a targeting domain of any of 2(b), 2(c), 2(d), 2(f), 2(g), 2(h), or 2(i).

In embodiments, the composition includes two gRNA molecules, and the targeting domain of said first gRNA molecule includes, for example, consists of, SEQ ID NO: 5519, SEQ ID NO: 5497, SEQ ID NO: 5499, SEQ ID NO: 5498, SEQ ID NO: 5503, SEQ ID NO: 5496, SEQ ID NO: 5507, SEQ ID NO: 5515, SEQ ID NO: 5493, SEQ ID NO: 5506, SEQ ID NO: 5509, SEQ ID NO: 5517, SEQ ID NO: 5521, SEQ ID NO: 5520, SEQ ID NO: 5500, SEQ ID NO: 5494, SEQ ID NO: 5508, SEQ ID NO: 5514, or SEQ ID NO: 5492; and the targeting domain of said second gRNA molecule includes, for example, consists of, SEQ ID NO: 5569, SEQ ID NO: 5585, SEQ ID NO: 5587, SEQ ID NO: 5592, SEQ ID NO: 5601, SEQ ID NO: 5589, SEQ ID NO: 5600, SEQ ID NO: 5594, SEQ ID NO: 5571, SEQ ID NO: 5593, SEQ ID NO: 5574, SEQ ID NO: 5598, SEQ ID NO: 5586, SEQ ID NO: 5599, SEQ ID NO: 5591, SEQ ID NO: 5610, SEQ ID NO: 5608, SEQ ID NO: 5617, SEQ ID NO: 5619, or SEQ ID NO: 5620.

In embodiments, the composition includes two gRNA molecules, and the targeting domain of said first gRNA molecule includes, for example, consists of, SEQ ID NO: 5496, SEQ ID NO: 5498, or SEQ ID NO: 5509; and the targeting domain of said second gRNA molecule includes, for example, consists of, SEQ ID NO: 5569, SEQ ID NO: 5586, SEQ ID NO: 5587, SEQ ID NO: 5592, SEQ ID NO: 5599, or SEQ ID NO: 5600.

In embodiments, the composition includes two gRNA molecules, and the targeting domain of said first gRNA molecule includes, for example, consists of, SEQ ID NO: 5496, SEQ ID NO: 5498, or SEQ ID NO: 5509; and the targeting domain of said second gRNA molecule includes, for example, consists of, SEQ ID NO: 5569.

In embodiments, the composition includes two gRNA molecules, and the targeting domain of said first gRNA molecule includes, for example, consists of, SEQ ID NO: 5496, SEQ ID NO: 5498, or SEQ ID NO: 5509; and the targeting domain of said second gRNA molecule includes, for example, consists of, SEQ ID NO: 10729, SEQ ID NO: 10719, SEQ ID NO: 10764, SEQ ID NO: 10789, SEQ ID NO: 10701, SEQ ID NO: 10700, or SEQ ID NO: 10722.

In embodiments, including in any of the aforementioned aspects and embodiments, the composition further includes a third gRNA molecule described herein, for example, in any of the aforementioned gRNA molecule aspects and embodiments, wherein the targeting domain of said third gRNA molecule is a targeting domain of any of 2(n) or 2(q). In embodiments, the targeting domain of said third gRNA molecule includes, for example, consists of, SEQ ID NO: 7771, SEQ ID NO: 7769, SEQ ID NO: 7773, SEQ ID NO: 7726, SEQ ID NO: 7758, SEQ ID NO: 7739, SEQ ID NO: 7779, SEQ ID NO: 7770, SEQ ID NO: 7749, SEQ ID NO: 7754, SEQ ID NO: 7745, SEQ ID NO: 7785, SEQ ID NO: 7731, SEQ ID NO: 7772, SEQ ID NO: 7743, or SEQ ID NO: 7750; for example, includes (for example consists of) SEQ ID NO: 7769, SEQ ID NO: 7771, SEQ ID NO: 7739, or SEQ ID NO: 7785.

In embodiments, including in any of the aforementioned aspects and embodiments, the composition further includes a fourth gRNA molecule described herein, for example, in any of the aforementioned gRNA molecule aspects and embodiments, wherein the targeting domain of said fourth gRNA molecule is complementary to a target sequence of a target of an NK inhibitory molecule, for example, LILRB1. In embodiments, the targeting domain of said fourth gRNA molecule includes, e.g., consists of:

a) any one of SEQ ID NO: 10090 to SEQ ID NO: 10673;
b) 17, 18, 19, 20, 21, 22, 23, or 24 consecutive nucleotides, preferably 20 consecutive nucleotides, of any one of SEQ ID NO: 10090 to SEQ ID NO: 10673.
c) The 5' 17, 18, 19, 20, 21, 22, 23 or 24 nucleotides, preferably 20 nucleotides, of any one of SEQ ID NO: 10090 to SEQ ID NO: 10673; or
d) The 3' 17, 18, 19, 20, 21, 22, 23 or 24 nucleotides, preferably 20 nucleotides, of any one of SEQ ID NO: 10090 to SEQ ID NO: 10673.

In embodiments of the composition (including in any of the aforementioned aspects and embodiments), the targeting domain of the first gRNA molecule (as described herein), the targeting domain of the second gRNA molecule (as described herein), and, if present, the targeting domain of the third gRNA molecule (as described herein), include, e.g., consist of, the sequences of any of:
  a) Combination A1 to combination A72 of Table 33;
  b) Combination B1 to combination B84 of Table 34;
  c) Combination C1 to combination C42 of Table 35;
  d) Combination D1 to combination D36 of Table 36;
  e) Combination E1 to combination E30 of Table 37; or
  f) Combination F1 to combination F60 of Table 38.

In any of the aforementioned aspects and embodiments, each of said gRNA molecules is in a ribonuclear protein complex (RNP) with a Cas9 molecule described herein.

In embodiments, the gRNA molecule or composition is formulated in a medium suitable for electroporation.

In embodiments wherein each of said gRNA molecules is in a RNP with a Cas9 molecule described herein, each of said RNP complexes is at a concentration of less than about 10 uM, e.g., less than about 3 uM, e.g., less than about 1 uM, e.g., less than about 0.5 uM, e.g., less than about 0.3 uM, e.g., less than about 0.1 uM.

In embodiments, the composition further includes a cell, e.g., a population of cells, e.g., an immune effector cell, e.g., a CAR-expressing immune effector cell, e.g., described herein.

In another aspect, the invention provides a nucleic acid that encodes a gRNA molecule of any of the previous gRNA molecule aspects or embodiments, or a (for example, all) component(s) of a composition of any of the aforementioned composition aspects and embodiments. In embodiments, the nucleic acid includes a promoter operably linked to the sequence that encodes the gRNA molecule. In embodiments, the promoter is a promoter recognized by an RNA polymerase II or RNA polymerase III. In other embodiments, the promoter is a U6 promoter or an H1 promoter. In embodiments, the nucleic acid further encodes a Cas9 molecule. In embodiments, the nucleic acid includes a promoter operably linked to the sequence that encodes a Cas9 molecule, for example, an EF-1 promoter, a CMV IE gene promoter, an EF-1α promoter, an ubiquitin C promoter, or a phosphoglycerate kinase (PGK) promoter.

In another aspect, the invention provides a vector that includes the nucleic acid of any of any of the aforementioned nucleic acid aspects and embodiments. In embodiments, the vector is selected from the group consisting of a lentiviral vector, an adenoviral vector, an adeno-associated viral (AAV) vector, a herpes simplex virus (HSV) vector, a plasmid, a minicircle, a nanoplasmid, and an RNA vector.

In another aspect, the invention provides a composition that includes a gRNA molecule of any the aforementioned gRNA molecule aspects and embodiments, and nucleic acid encoding a Cas9 molecule, for example, as described herein.

In another aspect, the invention provides a composition that includes a nucleic acid encoding a gRNA molecule of any the aforementioned gRNA molecule aspects and embodiments, and a Cas9 molecule, for example, as described herein.

In embodiments of any of the compositions of the invention, the composition further includes a template nucleic acid. In embodiments, the template nucleic acid includes a nucleotide that corresponds to a nucleotide of a target sequence of the gRNA molecule. In embodiments, the template nucleic acid includes nucleic acid encoding a chimeric antigen receptor (CAR), for example, as described herein. In embodiments, the CAR is (a) a CD19 CAR, e.g., as described in WO2012/079000 or WO2014/153270; or (b) a BCMA CAR, e.g., as described herein, e.g., a BCMA CAR including SEQ ID NO: 8559. In embodiments, the template nucleic acid includes nucleic acid encoding an NK inhibitory molecule, for example, as described herein.

In another aspect, the invention provides a method of altering e.g., altering the structure, e.g., sequence of, a target sequence of a cell, including contacting said cell with a) a gRNA molecule, e.g., more than one gRNA molecule, of any of the previous gRNA molecule aspects and embodiments, and a Cas9 molecule, for example, as described herein; b) a gRNA molecule, e.g., more than one gRNA molecule, of any of the previous gRNA molecule aspects and embodiments and nucleic acid encoding a Cas9 molecule, for example, as described herein; c) nucleic acid encoding a gRNA molecule, e.g., more than one gRNA molecule, of any of the previous gRNA molecule aspects and embodiments and a Cas9 molecule, for example, as described herein; d) nucleic acid encoding a gRNA molecule, e.g., more than one gRNA molecule, of any of the previous gRNA molecule aspects and embodiments and nucleic acid encoding a Cas9 molecule, for example, as described herein; e) any of a) to d), above, and a template nucleic acid; f) any of a) to d) above, and nucleic acid including sequence encoding a template nucleic acid; g) a composition of any of the previous composition aspects and embodiments; or h) a vector of any of the previous vector aspects and embodiments. In embodiments, the gRNA molecule or nucleic acid encoding the gRNA molecule, and the Cas9 molecule or nucleic acid encoding the Cas9 molecule, are formulated in a single composition. In other embodiments, the gRNA molecule or nucleic acid encoding the gRNA molecule, and the Cas9 molecule or nucleic acid encoding the Cas9 molecule, are formulated in more than one composition. In embodiments, the more than one composition are delivered, for example, delivered to a cell described herein, simultaneously or sequentially. In embodiments, the cell is an animal cell, for example, a mammalian, primate, or human cell. In embodiments, the cell is an immune effector cell (e.g., a population of immune effector cells), for example, a T cell or NK cell, for example, T cell, for example, a CD4+ T cell, a CD8+ T cell, or a combination thereof. In embodiments, the cell has been, or will be, engineered to express a chimeric antigen receptor (CAR), for example, as described herein. In embodiments, the cell includes, or will include a chimeric antigen receptor (CAR), for example, as described herein. In embodiments, the cell includes, or will include nucleic acid encoding a chimeric antigen receptor (CAR), for example, as described herein. In embodiments, the CAR is (a) a CD19 CAR; or (b) a BCMA CAR. In embodiments, the CAR is a CD19 CAR including an antigen binding domain including any one of SEQ ID NO: 7883 to SEQ ID NO: 7898. In embodiments, the CAR is a CD19 CAR and includes any one of SEQ ID NO: 7908 to SEQ ID NO: 7920. In embodiments, the CAR is a BCMA CAR including an antigen binding domain including any one of SEQ ID NO:

7939 to SEQ ID NO: 8112. In embodiments, the CAR is a BCMA CAR and includes any one of SEQ ID NO: 8549 to SEQ ID NO: 8621, e.g., includes SEQ ID NO: 8559. In embodiments the cell is allogeneic with respect to a patient to be administered said cell. In embodiments, the cell is isolated from a healthy human donor. In embodiments the cell is autologous with respect to a patient to be administered said cell.

In another aspect, the invention provides a cell, altered by a method of any of the aforementioned method aspects and embodiments, for example, altered by a method described herein. In another aspect, the invention provides a cell that includes a first gRNA molecule of any of the aforementioned gRNA molecule aspects and embodiments, or a composition of any of the aforementioned composition aspects and embodiments, a nucleic acid of any of the aforementioned nucleic acid aspects and embodiments, or a vector of any of the aforementioned vector aspects and embodiments. In embodiments, the gRNA molecule, composition, nucleic acid or vector is introduced into said cell ex vivo. In other embodiments, the gRNA molecule, composition, nucleic acid or vector is introduced into said cell in vivo. In embodiments, the cell is an animal cell, for example, a mammalian, primate, or human cell. In embodiments, the cell is an immune effector cell (e.g., a population of immune effector cells), for example, a T cell or NK cell, for example, T cell, for example, a CD4+ T cell, a CD8+ T cell, or a combination thereof. In embodiments, the cell has been, or will be, engineered to express a chimeric antigen receptor (CAR), for example, as described herein. In embodiments, the cell includes, or will include a chimeric antigen receptor (CAR), for example, as described herein. In embodiments, the cell includes, or will include nucleic acid encoding a chimeric antigen receptor (CAR), for example, as described herein. In embodiments, the CAR is (a) a CD19 CAR; or (b) a BCMA CAR. In embodiments, the CAR is a CD19 CAR including an antigen binding domain including any one of SEQ ID NO: 7883 to SEQ ID NO: 7898. In embodiments, the CAR is a CD19 CAR and includes any one of SEQ ID NO: 7908 to SEQ ID NO: 7920. In embodiments, the CAR is a BCMA CAR including an antigen binding domain including any one of SEQ ID NO: 7939 to SEQ ID NO: 8112. In embodiments, the CAR is a BCMA CAR and includes any one of SEQ ID NO: 8549 to SEQ ID NO: 8621, e.g., includes SEQ ID NO: 8559. In embodiments the cell is allogeneic with respect to a patient to be administered said cell. In embodiments, the cell is isolated from a healthy human donor. In embodiments the cell is autologous with respect to a patient to be administered said cell. In embodiments, the cell includes, has included, or will include a second gRNA molecule, or a nucleic acid encoding the second gRNA molecule of any of the aforementioned gRNA molecule aspects and embodiments, wherein the first gRNA molecule and second gRNA molecule include nonidentical targeting domains. In embodiments, the first gRNA molecule includes a targeting domain complementary with a target sequence of an allogeneic T-cell target (e.g., a targeting domain described in Tables 1, 3, 4 or 5), and the second gRNA molecule includes a targeting domain complementary with a target sequence of an inhibitory molecule or downstream effector of signaling through an inhibitory molecule (e.g., includes a targeting domain described in Table 2 or Table 6). In embodiments, the inhibitory molecule or downstream effector of signaling through an inhibitory molecule is CD274, HAVCR2, LAG3, PDCD1, PD-L2, CTLA4, CEACAM (e.g., CEACAM-1, CEACAM-3 and/or CEACAM-5), VISTA, BTLA, TIGIT, LAIR1, CD160, 2B4, CD80, CD86, B7-H14 (CD113), B7-H4 (VTCN1), HVEM (TNFRSF14 or CD107), KIR, A2aR, MHC class I, MHC class II, GAL9, adenosine, and TGF beta, or PTPN11. In embodiments, the first gRNA molecule includes a targeting domain complementary with a target sequence of TRAC, TRBC1, TRBC2, CD247, CD3D, CD3E, or CD3G, and the second gRNA molecule includes a targeting domain complementary with a target sequence of NLRC5, e.g., includes a targeting domain including (e.g., consisting of) any one of SEQ ID NO: 8622 to SEQ ID NO: 10089. In embodiments, the first gRNA molecule includes a targeting domain complementary with a target sequence of TRAC, TRBC1, TRBC2, CD247, CD3D, CD3E, or CD3G, and the second gRNA molecule includes a targeting domain complementary with a target sequence of B2M, HLA-A, HLA-B or HLA-C. In embodiments, the cell further includes, has included, or will include a third gRNA molecule of any of the aforementioned gRNA molecule aspects and embodiments, or a nucleic acid encoding the third gRNA molecule of any of the aforementioned gRNA molecule aspects and embodiments, wherein the first gRNA molecule, the second gRNA molecule and the third gRNA molecule include nonidentical targeting domains. In embodiments, the third gRNA molecule includes a targeting domain complementary with a target sequence of CIITA, RFXANK, RFX5, or RFXAP, e.g., CIITA, e.g., includes a targeting domain including, e.g., consisting of, any one of SEQ ID NO: 7717 to SEQ ID NO: 7804, e.g., includes a targeting domain including, e.g., consisting of, any one of SEQ ID NO: 7769, SEQ ID NO: 7771, or SEQ ID NO: 7785. In embodiments, the cell includes three gRNA molecules, and the first gRNA molecule includes a targeting domain complementary with a target sequence of TRAC; the second gRNA molecule includes a targeting domain complementary with a target sequence of B2M; and the third gRNA molecule includes a targeting domain complementary with a target sequence of CIITA. In embodiments, the cell includes three gRNA molecules, and the first gRNA molecule includes a targeting domain complementary with a target sequence of TRAC; the second gRNA molecule includes a targeting domain complementary with a target sequence of NLRC5; and the third gRNA molecule includes a targeting domain complementary with a target sequence of CIITA. In embodiments, the cell includes two gRNA molecules, and the first gRNA molecule includes a targeting domain complementary with a target sequence of TRAC, TRBC1, TRBC2, CD247, CD3D, CD3E, or CD3G, and the second gRNA molecule includes a targeting domain complementary with a target sequence of NR3C1, DCK, CD52 or FKBP1A.

In embodiments of the cell which includes a gRNA molecule (e.g., more than one gRNA molecule described herein):
(1) the first gRNA molecule includes a targeting domain selected from the group consisting of SEQ ID NO: 5528 to SEQ ID NO: 5623 or SEQ ID NO: 5816 to SEQ ID NO: 5965, and the second guide RNA molecule includes a targeting domain selected from the group consisting of SEQ ID NO: 1 to SEQ ID NO: 83 and SEQ ID NO: 5492 to SEQ ID NO: 5527;
(2) the first gRNA molecule includes a targeting domain selected from the group consisting of SEQ ID NO: 5528 to SEQ ID NO: 5623 or SEQ ID NO: 5816 to SEQ ID NO: 5965, and the second guide RNA molecule includes a targeting domain selected from the group consisting of SEQ ID NO: 969 to SEQ ID NO: 1345;

(3) the first gRNA molecule includes a targeting domain selected from the group consisting of SEQ ID NO: 5528 to SEQ ID NO: 5623 or SEQ ID NO: 5816 to SEQ ID NO: 5965, and the second guide RNA molecule includes a targeting domain selected from the group consisting of SEQ ID NO: 1346 to SEQ ID NO: 1698;

(4) the first gRNA molecule includes a targeting domain selected from the group consisting of SEQ ID NO: 5528 to SEQ ID NO: 5623 or SEQ ID NO: 5816 to SEQ ID NO: 5965, and the second guide RNA molecule includes a targeting domain selected from the group consisting of SEQ ID NO: 1699 to SEQ ID NO: 2068;

(5) the first gRNA molecule includes a targeting domain selected from the group consisting of SEQ ID NO: 5528 to SEQ ID NO: 5623 or SEQ ID NO: 5816 to SEQ ID NO: 5965, and the second guide RNA molecule includes a targeting domain selected from the group consisting of SEQ ID NO: 2069 to SEQ ID NO: 2941;

(6) the first gRNA molecule includes a targeting domain selected from the group consisting of SEQ ID NO: 5528 to SEQ ID NO: 5623 or SEQ ID NO: 5816 to SEQ ID NO: 5965, and the second guide RNA molecule includes a targeting domain selected from the group consisting of SEQ ID NO: 5278 to SEQ ID NO: 5491;

(7) the first gRNA molecule includes a targeting domain selected from the group consisting of SEQ ID NO: 5528 to SEQ ID NO: 5623 or SEQ ID NO: 5816 to SEQ ID NO: 5965, and the second guide RNA molecule includes a targeting domain selected from the group consisting of SEQ ID NO: 6227 to SEQ ID NO: 6324;

(8) the first gRNA molecule includes a targeting domain selected from the group consisting of SEQ ID NO: 5528 to SEQ ID NO: 5623 or SEQ ID NO: 5816 to SEQ ID NO: 5965, and the second guide RNA molecule includes a targeting domain selected from the group consisting of SEQ ID NO: 6325 to SEQ ID NO: 6583;

(9) the first gRNA molecule includes a targeting domain selected from the group consisting of SEQ ID NO: 5624 to SEQ ID NO: 5643 or SEQ ID NO: 5966 to SEQ ID NO: 6097, and the second guide RNA molecule includes a targeting domain selected from the group consisting of SEQ ID NO: 1 to SEQ ID NO: 83 and SEQ ID NO: 5492 to SEQ ID NO: 5527;

(10) the first gRNA molecule includes a targeting domain selected from the group consisting of SEQ ID NO: 5624 to SEQ ID NO: 5643 or SEQ ID NO: 5966 to SEQ ID NO: 6097, and the second guide RNA molecule includes a targeting domain selected from the group consisting of SEQ ID NO: 969 to SEQ ID NO: 1345;

(11) the first gRNA molecule includes a targeting domain selected from the group consisting of SEQ ID NO: 5624 to SEQ ID NO: 5643 or SEQ ID NO: 5966 to SEQ ID NO: 6097, and the second guide RNA molecule includes a targeting domain selected from the group consisting of SEQ ID NO: 1346 to SEQ ID NO: 1698;

(12) the first gRNA molecule includes a targeting domain selected from the group consisting of SEQ ID NO: 5624 to SEQ ID NO: 5643 or SEQ ID NO: 5966 to SEQ ID NO: 6097, and the second guide RNA molecule includes a targeting domain selected from the group consisting of SEQ ID NO: 1699 to SEQ ID NO: 2068;

(13) the first gRNA molecule includes a targeting domain selected from the group consisting of SEQ ID NO: 5624 to SEQ ID NO: 5643 or SEQ ID NO: 5966 to SEQ ID NO: 6097, and the second guide RNA molecule includes a targeting domain selected from the group consisting of SEQ ID NO: 2069 to SEQ ID NO: 2941;

(14) the first gRNA molecule includes a targeting domain selected from the group consisting of SEQ ID NO: 5624 to SEQ ID NO: 5643 or SEQ ID NO: 5966 to SEQ ID NO: 6097, and the second guide RNA molecule includes a targeting domain selected from the group consisting of SEQ ID NO: 5278 to SEQ ID NO: 5491;

(15) the first gRNA molecule includes a targeting domain selected from the group consisting of SEQ ID NO: 5624 to SEQ ID NO: 5643 or SEQ ID NO: 5966 to SEQ ID NO: 6097, and the second guide RNA molecule includes a targeting domain selected from the group consisting of SEQ ID NO: 6227 to SEQ ID NO: 6324;

(16) the first gRNA molecule includes a targeting domain selected from the group consisting of SEQ ID NO: 5624 to SEQ ID NO: 5643 or SEQ ID NO: 5966 to SEQ ID NO: 6097, and the second guide RNA molecule includes a targeting domain selected from the group consisting of SEQ ID NO: 6325 to SEQ ID NO: 6583;

(17) the first gRNA molecule includes a targeting domain selected from the group consisting of SEQ ID NO: 5644 to SEQ ID NO: 5719 or SEQ ID NO: 6098 to SEQ ID NO: 6226, and the second guide RNA molecule includes a targeting domain selected from the group consisting of SEQ ID NO: 1 to SEQ ID NO: 83 and SEQ ID NO: 5492 to SEQ ID NO: 5527;

(18) the first gRNA molecule includes a targeting domain selected from the group consisting of SEQ ID NO: 5644 to SEQ ID NO: 5719 or SEQ ID NO: 6098 to SEQ ID NO: 6226, and the second guide RNA molecule includes a targeting domain selected from the group consisting of SEQ ID NO: 969 to SEQ ID NO: 1345;

(19) the first gRNA molecule includes a targeting domain selected from the group consisting of SEQ ID NO: 5644 to SEQ ID NO: 5719 or SEQ ID NO: 6098 to SEQ ID NO: 6226, and the second guide RNA molecule includes a targeting domain selected from the group consisting of SEQ ID NO: 1346 to SEQ ID NO: 1698;

(20) the first gRNA molecule includes a targeting domain selected from the group consisting of SEQ ID NO: 5644 to SEQ ID NO: 5719 or SEQ ID NO: 6098 to SEQ ID NO: 6226, and the second guide RNA molecule includes a targeting domain selected from the group consisting of SEQ ID NO: 1699 to SEQ ID NO: 2068;

(21) the first gRNA molecule includes a targeting domain selected from the group consisting of SEQ ID NO: 5644 to SEQ ID NO: 5719 or SEQ ID NO: 6098 to SEQ ID NO: 6226, and the second guide RNA molecule includes a targeting domain selected from the group consisting of SEQ ID NO: 2069 to SEQ ID NO: 2941;

(22) the first gRNA molecule includes a targeting domain selected from the group consisting of SEQ ID NO: 5644 to SEQ ID NO: 5719 or SEQ ID NO: 6098 to SEQ ID NO: 6226, and the second guide RNA molecule includes a targeting domain selected from the group consisting of SEQ ID NO: 5278 to SEQ ID NO: 5491;

(23) the first gRNA molecule includes a targeting domain selected from the group consisting of SEQ ID NO: 5644 to SEQ ID NO: 5719 or SEQ ID NO: 6098 to SEQ ID NO: 6226, and the second guide RNA molecule includes a targeting domain selected from the group consisting of SEQ ID NO: 6227 to SEQ ID NO: 6324;

(24) the first gRNA molecule includes a targeting domain selected from the group consisting of SEQ ID NO: 5644 to SEQ ID NO: 5719 or SEQ ID NO: 6098 to SEQ ID NO: 6226, and the second guide RNA molecule includes a targeting domain selected from the group consisting of SEQ ID NO: 6325 to SEQ ID NO: 6583;

(25) the first gRNA molecule includes a targeting domain selected from the group consisting of SEQ ID NO: 84 to SEQ ID NO: 392, and the second guide RNA molecule includes a targeting domain selected from the group consisting of SEQ ID NO: 1 to SEQ ID NO: 83 and SEQ ID NO: 5492 to SEQ ID NO: 5527;

(26) the first gRNA molecule includes a targeting domain selected from the group consisting of SEQ ID NO: 84 to SEQ ID NO: 392, and the second guide RNA molecule includes a targeting domain selected from the group consisting of SEQ ID NO: 969 to SEQ ID NO: 1345;

(27) the first gRNA molecule includes a targeting domain selected from the group consisting of SEQ ID NO: 84 to SEQ ID NO: 392, and the second guide RNA molecule includes a targeting domain selected from the group consisting of SEQ ID NO: 1346 to SEQ ID NO: 1698;

(28) the first gRNA molecule includes a targeting domain selected from the group consisting of SEQ ID NO: 84 to SEQ ID NO: 392, and the second guide RNA molecule includes a targeting domain selected from the group consisting of SEQ ID NO: 1699 to SEQ ID NO: 2068;

(29) the first gRNA molecule includes a targeting domain selected from the group consisting of SEQ ID NO: 84 to SEQ ID NO: 392, and the second guide RNA molecule includes a targeting domain selected from the group consisting of SEQ ID NO: 2069 to SEQ ID NO: 2941;

(30) the first gRNA molecule includes a targeting domain selected from the group consisting of SEQ ID NO: 84 to SEQ ID NO: 392, and the second guide RNA molecule includes a targeting domain selected from the group consisting of SEQ ID NO: 5278 to SEQ ID NO: 5491;

(31) the first gRNA molecule includes a targeting domain selected from the group consisting of SEQ ID NO: 84 to SEQ ID NO: 392, and the second guide RNA molecule includes a targeting domain selected from the group consisting of SEQ ID NO: 6227 to SEQ ID NO: 6324;

(32) the first gRNA molecule includes a targeting domain selected from the group consisting of SEQ ID NO: 84 to SEQ ID NO: 392, and the second guide RNA molecule includes a targeting domain selected from the group consisting of SEQ ID NO: 6325 to SEQ ID NO: 6583;

(33) the first gRNA molecule includes a targeting domain selected from the group consisting of SEQ ID NO: 393 to SEQ ID NO: 532, and the second guide RNA molecule includes a targeting domain selected from the group consisting of SEQ ID NO: 1 to SEQ ID NO: 83 and SEQ ID NO: 5492 to SEQ ID NO: 5527;

(34) the first gRNA molecule includes a targeting domain selected from the group consisting of SEQ ID NO: 393 to SEQ ID NO: 532, and the second guide RNA molecule includes a targeting domain selected from the group consisting of SEQ ID NO: 969 to SEQ ID NO: 1345;

(35) the first gRNA molecule includes a targeting domain selected from the group consisting of SEQ ID NO: 393 to SEQ ID NO: 532, and the second guide RNA molecule includes a targeting domain selected from the group consisting of SEQ ID NO: 1346 to SEQ ID NO: 1698;

(36) the first gRNA molecule includes a targeting domain selected from the group consisting of SEQ ID NO: 393 to SEQ ID NO: 532, and the second guide RNA molecule includes a targeting domain selected from the group consisting of SEQ ID NO: 1699 to SEQ ID NO: 2068;

(37) the first gRNA molecule includes a targeting domain selected from the group consisting of SEQ ID NO: 393 to SEQ ID NO: 532, and the second guide RNA molecule includes a targeting domain selected from the group consisting of SEQ ID NO: 2069 to SEQ ID NO: 2941;

(38) the first gRNA molecule includes a targeting domain selected from the group consisting of SEQ ID NO: 393 to SEQ ID NO: 532, and the second guide RNA molecule includes a targeting domain selected from the group consisting of SEQ ID NO: 5278 to SEQ ID NO: 5491;

(39) the first gRNA molecule includes a targeting domain selected from the group consisting of SEQ ID NO: 393 to SEQ ID NO: 532, and the second guide RNA molecule includes a targeting domain selected from the group consisting of SEQ ID NO: 6227 to SEQ ID NO: 6324;

(40) the first gRNA molecule includes a targeting domain selected from the group consisting of SEQ ID NO: 393 to SEQ ID NO: 532, and the second guide RNA molecule includes a targeting domain selected from the group consisting of SEQ ID NO: 6325 to SEQ ID NO: 6583;

(41) the first gRNA molecule includes a targeting domain selected from the group consisting of SEQ ID NO: 533 to SEQ ID NO: 839, and the second guide RNA molecule includes a targeting domain selected from the group consisting of SEQ ID NO: 1 to SEQ ID NO: 83 and SEQ ID NO: 5492 to SEQ ID NO: 5527;

(42) the first gRNA molecule includes a targeting domain selected from the group consisting of SEQ ID NO: 533 to SEQ ID NO: 839, and the second guide RNA molecule includes a targeting domain selected from the group consisting of SEQ ID NO: 969 to SEQ ID NO: 1345;

(43) the first gRNA molecule includes a targeting domain selected from the group consisting of SEQ ID NO: 533 to SEQ ID NO: 839, and the second guide RNA molecule includes a targeting domain selected from the group consisting of SEQ ID NO: 1346 to SEQ ID NO: 1698;

(44) the first gRNA molecule includes a targeting domain selected from the group consisting of SEQ ID NO: 533 to SEQ ID NO: 839, and the second guide RNA molecule includes a targeting domain selected from the group consisting of SEQ ID NO: 1699 to SEQ ID NO: 2068;

(45) the first gRNA molecule includes a targeting domain selected from the group consisting of SEQ ID NO: 533 to SEQ ID NO: 839, and the second guide RNA molecule includes a targeting domain selected from the group consisting of SEQ ID NO: 2069 to SEQ ID NO: 2941;

(46) the first gRNA molecule includes a targeting domain selected from the group consisting of SEQ ID NO: 533 to SEQ ID NO: 839, and the second guide RNA molecule includes a targeting domain selected from the group consisting of SEQ ID NO: 5278 to SEQ ID NO: 5491;

(47) the first gRNA molecule includes a targeting domain selected from the group consisting of SEQ ID NO: 533 to SEQ ID NO: 839, and the second guide RNA molecule includes a targeting domain selected from the group consisting of SEQ ID NO: 6227 to SEQ ID NO: 6324;

(48) the first gRNA molecule includes a targeting domain selected from the group consisting of SEQ ID NO: 533 to SEQ ID NO: 839, and the second guide RNA molecule includes a targeting domain selected from the group consisting of SEQ ID NO: 6325 to SEQ ID NO: 6583;

(49) the first gRNA molecule includes a targeting domain selected from the group consisting of SEQ ID NO: 840 to SEQ ID NO: 968, and the second guide RNA molecule includes a targeting domain selected from the group consisting of SEQ ID NO: 1 to SEQ ID NO: 83 and SEQ ID NO: 5492 to SEQ ID NO: 5527;

(50) the first gRNA molecule includes a targeting domain selected from the group consisting of SEQ ID NO: 840 to SEQ ID NO: 968, and the second guide RNA molecule includes a targeting domain selected from the group consisting of SEQ ID NO: 969 to SEQ ID NO: 1345;

(51) the first gRNA molecule includes a targeting domain selected from the group consisting of SEQ ID NO: 840 to SEQ ID NO: 968, and the second guide RNA molecule includes a targeting domain selected from the group consisting of SEQ ID NO: 1346 to SEQ ID NO: 1698;

(52) the first gRNA molecule includes a targeting domain selected from the group consisting of SEQ ID NO: 840 to SEQ ID NO: 968, and the second guide RNA molecule includes a targeting domain selected from the group consisting of SEQ ID NO: 1699 to SEQ ID NO: 2068;

(53) the first gRNA molecule includes a targeting domain selected from the group consisting of SEQ ID NO: 840 to SEQ ID NO: 968, and the second guide RNA molecule includes a targeting domain selected from the group consisting of SEQ ID NO: 2069 to SEQ ID NO: 2941;

(54) the first gRNA molecule includes a targeting domain selected from the group consisting of SEQ ID NO: 840 to SEQ ID NO: 968, and the second guide RNA molecule includes a targeting domain selected from the group consisting of SEQ ID NO: 5278 to SEQ ID NO: 5491;

(55) the first gRNA molecule includes a targeting domain selected from the group consisting of SEQ ID NO: 840 to SEQ ID NO: 968, and the second guide RNA molecule includes a targeting domain selected from the group consisting of SEQ ID NO: 6227 to SEQ ID NO: 6324; or

(56) the first gRNA molecule includes a targeting domain selected from the group consisting of SEQ ID NO: 840 to SEQ ID NO: 968, and the second guide RNA molecule includes a targeting domain selected from the group consisting of SEQ ID NO: 6325 to SEQ ID NO: 6583.

In embodiments, including in any of the aforementioned cell aspects and embodiments, the cell further includes a third gRNA molecule including a targeting domain complementary with a target sequence of an inhibitory molecule or downstream effector of signaling through an inhibitory molecule, wherein the inhibitory molecule or downstream effector of signaling through an inhibitory molecule is CD274, HAVCR2, LAG3, PDCD1, PD-L2, CTLA4, CEACAM (e.g., CEACAM-1, CEACAM-3 and/or CEACAM-5), VISTA, BTLA, TIGIT, LAIR1, CD160, 2B4, CD80, CD86, B7-H3 (CD113), B7-H4 (VTCN1), HVEM (TNFRSF14 or CD107), KIR, A2aR, MHC class I, MHC class II, GAL9, adenosine, and TGF beta, or PTPN11, for example, the third gRNA molecule is comprises a targeting domain of any of 15(a) to 15(e).

In embodiments of the cell which includes a gRNA molecule (e.g., more than one gRNA molecule described herein):

(1) the first gRNA molecule includes a targeting domain selected from the group consisting of SEQ ID NO: 5528 to SEQ ID NO: 5623 or SEQ ID NO: 5816 to SEQ ID NO: 5965, and the second guide RNA molecule includes a targeting domain selected from the group consisting of SEQ ID NO: 2942 to SEQ ID NO: 3270;

(2) the first gRNA molecule includes a targeting domain selected from the group consisting of SEQ ID NO: 5528 to SEQ ID NO: 5623 or SEQ ID NO: 5816 to SEQ ID NO: 5965, and the second guide RNA molecule includes a targeting domain selected from the group consisting of SEQ ID NO: 3271 to SEQ ID NO: 3541;

(3) the first gRNA molecule includes a targeting domain selected from the group consisting of SEQ ID NO: 5528 to SEQ ID NO: 5623 or SEQ ID NO: 5816 to SEQ ID NO: 5965, and the second guide RNA molecule includes a targeting domain selected from the group consisting of SEQ ID NO: 3542 to SEQ ID NO: 4032;

(4) the first gRNA molecule includes a targeting domain selected from the group consisting of SEQ ID NO: 5528 to SEQ ID NO: 5623 or SEQ ID NO: 5816 to SEQ ID NO: 5965, and the second guide RNA molecule includes a targeting domain selected from the group consisting of SEQ ID NO: 4033 to SEQ ID NO: 4589 and SEQ ID NO: 5720 to SEQ ID NO: 5815;

(5) the first gRNA molecule includes a targeting domain selected from the group consisting of SEQ ID NO: 5528 to SEQ ID NO: 5623 or SEQ ID NO: 5816 to SEQ ID NO: 5965, and the second guide RNA molecule includes a targeting domain selected from the group consisting of SEQ ID NO: 4590 to SEQ ID NO: 5277;

(6) the first gRNA molecule includes a targeting domain selected from the group consisting of SEQ ID NO: 5624 to SEQ ID NO: 5643 or SEQ ID NO: 5966 to SEQ ID NO: 6097, and the second guide RNA molecule includes a targeting domain selected from the group consisting of SEQ ID NO: 2942 to SEQ ID NO: 3270;

(7) the first gRNA molecule includes a targeting domain selected from the group consisting of SEQ ID NO: 5624 to SEQ ID NO: 5643 or SEQ ID NO: 5966 to SEQ ID NO: 6097, and the second guide RNA molecule includes a targeting domain selected from the group consisting of SEQ ID NO: 3271 to SEQ ID NO: 3541;

(8) the first gRNA molecule includes a targeting domain selected from the group consisting of SEQ ID NO: 5624 to SEQ ID NO: 5643 or SEQ ID NO: 5966 to SEQ ID NO: 6097, and the second guide RNA molecule includes a targeting domain selected from the group consisting of SEQ ID NO: 3542 to SEQ ID NO: 4032;

(9) the first gRNA molecule includes a targeting domain selected from the group consisting of SEQ ID NO: 5624 to SEQ ID NO: 5643 or SEQ ID NO: 5966 to SEQ ID NO: 6097, and the second guide RNA molecule includes a targeting domain selected from the group consisting of SEQ ID NO: 4033 to SEQ ID NO: 4589 and SEQ ID NO: 5720 to SEQ ID NO: 5815;

(10) the first gRNA molecule includes a targeting domain selected from the group consisting of SEQ ID NO: 5624 to SEQ ID NO: 5643 or SEQ ID NO: 5966 to SEQ ID NO: 6097, and the second guide RNA molecule includes a targeting domain selected from the group consisting of SEQ ID NO: 4590 to SEQ ID NO: 5277;

(11) the first gRNA molecule includes a targeting domain selected from the group consisting of SEQ ID NO: 5644 to SEQ ID NO: 5719 or SEQ ID NO: 6098 to SEQ ID NO: 6226, and the second guide RNA molecule includes a targeting domain selected from the group consisting of SEQ ID NO: 2942 to SEQ ID NO: 3270;

(12) the first gRNA molecule includes a targeting domain selected from the group consisting of SEQ ID NO: 5644 to SEQ ID NO: 5719 or SEQ ID NO: 6098 to SEQ ID NO: 6226, and the second guide RNA molecule includes a targeting domain selected from the group consisting of SEQ ID NO: 3271 to SEQ ID NO: 3541;

(13) the first gRNA molecule includes a targeting domain selected from the group consisting of SEQ ID NO: 5644 to SEQ ID NO: 5719 or SEQ ID NO: 6098 to SEQ ID NO: 6226, and the second guide RNA molecule includes a targeting domain selected from the group consisting of SEQ ID NO: 3542 to SEQ ID NO: 4032;

(14) the first gRNA molecule includes a targeting domain selected from the group consisting of SEQ ID NO: 5644 to SEQ ID NO: 5719 or SEQ ID NO: 6098 to SEQ ID NO: 6226, and the second guide RNA molecule includes a targeting domain selected from the group consisting of SEQ ID NO: 4033 to SEQ ID NO: 4589 and SEQ ID NO: 5720 to SEQ ID NO: 5815;

(15) the first gRNA molecule includes a targeting domain selected from the group consisting of SEQ ID NO: 5644 to SEQ ID NO: 5719 or SEQ ID NO: 6098 to SEQ ID NO: 6226, and the second guide RNA molecule includes a targeting domain selected from the group consisting of SEQ ID NO: 4590 to SEQ ID NO: 5277;

(16) the first gRNA molecule includes a targeting domain selected from the group consisting of SEQ ID NO: 84 to SEQ ID NO: 392, and the second guide RNA molecule includes a targeting domain selected from the group consisting of SEQ ID NO: 2942 to SEQ ID NO: 3270;

(17) the first gRNA molecule includes a targeting domain selected from the group consisting of SEQ ID NO: 84 to SEQ ID NO: 392, and the second guide RNA molecule includes a targeting domain selected from the group consisting of SEQ ID NO: 3271 to SEQ ID NO: 3541;

(18) the first gRNA molecule includes a targeting domain selected from the group consisting of SEQ ID NO: 84 to SEQ ID NO: 392, and the second guide RNA molecule includes a targeting domain selected from the group consisting of SEQ ID NO: 3542 to SEQ ID NO: 4032;

(19) the first gRNA molecule includes a targeting domain selected from the group consisting of SEQ ID NO: 84 to SEQ ID NO: 392, and the second guide RNA molecule includes a targeting domain selected from the group consisting of SEQ ID NO: 4033 to SEQ ID NO: 4589 and SEQ ID NO: 5720 to SEQ ID NO: 5815;

(20) the first gRNA molecule includes a targeting domain selected from the group consisting of SEQ ID NO: 84 to SEQ ID NO: 392, and the second guide RNA molecule includes a targeting domain selected from the group consisting of SEQ ID NO: 4590 to SEQ ID NO: 5277;

(21) the first gRNA molecule includes a targeting domain selected from the group consisting of SEQ ID NO: 393 to SEQ ID NO: 532, and the second guide RNA molecule includes a targeting domain selected from the group consisting of SEQ ID NO: 2942 to SEQ ID NO: 3270;

(22) the first gRNA molecule includes a targeting domain selected from the group consisting of SEQ ID NO: 393 to SEQ ID NO: 532, and the second guide RNA molecule includes a targeting domain selected from the group consisting of SEQ ID NO: 3271 to SEQ ID NO: 3541;

(23) the first gRNA molecule includes a targeting domain selected from the group consisting of SEQ ID NO: 393 to SEQ ID NO: 532, and the second guide RNA molecule includes a targeting domain selected from the group consisting of SEQ ID NO: 3542 to SEQ ID NO: 4032;

(24) the first gRNA molecule includes a targeting domain selected from the group consisting of SEQ ID NO: 393 to SEQ ID NO: 532, and the second guide RNA molecule includes a targeting domain selected from the group consisting of SEQ ID NO: 4033 to SEQ ID NO: 4589 and SEQ ID NO: 5720 to SEQ ID NO: 5815;

(25) the first gRNA molecule includes a targeting domain selected from the group consisting of SEQ ID NO: 393 to SEQ ID NO: 532, and the second guide RNA molecule includes a targeting domain selected from the group consisting of SEQ ID NO: 4590 to SEQ ID NO: 5277;

(26) the first gRNA molecule includes a targeting domain selected from the group consisting of SEQ ID NO: 533 to SEQ ID NO: 839, and the second guide RNA molecule includes a targeting domain selected from the group consisting of SEQ ID NO: 2942 to SEQ ID NO: 3270;

(27) the first gRNA molecule includes a targeting domain selected from the group consisting of SEQ ID NO: 533 to SEQ ID NO: 839, and the second guide RNA molecule includes a targeting domain selected from the group consisting of SEQ ID NO: 3271 to SEQ ID NO: 3541;

(28) the first gRNA molecule includes a targeting domain selected from the group consisting of SEQ ID NO: 533 to SEQ ID NO: 839, and the second guide RNA molecule includes a targeting domain selected from the group consisting of SEQ ID NO: 3542 to SEQ ID NO: 4032;

(29) the first gRNA molecule includes a targeting domain selected from the group consisting of SEQ ID NO: 533 to SEQ ID NO: 839, and the second guide RNA molecule includes a targeting domain selected from the group consisting of SEQ ID NO: 4033 to SEQ ID NO: 4589 and SEQ ID NO: 5720 to SEQ ID NO: 5815;

(30) the first gRNA molecule includes a targeting domain selected from the group consisting of SEQ ID NO: 533 to SEQ ID NO: 839, and the second guide RNA molecule includes a targeting domain selected from the group consisting of SEQ ID NO: 4590 to SEQ ID NO: 5277;

(31) the first gRNA molecule includes a targeting domain selected from the group consisting of SEQ ID NO: 840 to SEQ ID NO: 968, and the second guide RNA molecule includes a targeting domain selected from the group consisting of SEQ ID NO: 2942 to SEQ ID NO: 3270;

(32) the first gRNA molecule includes a targeting domain selected from the group consisting of SEQ ID NO: 840 to SEQ ID NO: 968, and the second guide RNA molecule includes a targeting domain selected from the group consisting of SEQ ID NO: 3271 to SEQ ID NO: 3541;

(33) the first gRNA molecule includes a targeting domain selected from the group consisting of SEQ ID NO: 840 to SEQ ID NO: 968, and the second guide RNA molecule includes a targeting domain selected from the group consisting of SEQ ID NO: 3542 to SEQ ID NO: 4032;

(34) the first gRNA molecule includes a targeting domain selected from the group consisting of SEQ ID NO: 840 to SEQ ID NO: 968, and the second guide RNA molecule includes a targeting domain selected from the group consisting of SEQ ID NO: 4033 to SEQ ID NO: 4589 and SEQ ID NO: 5720 to SEQ ID NO: 5815; or

(35) the first gRNA molecule includes a targeting domain selected from the group consisting of SEQ ID NO: 840 to SEQ ID NO: 968, and the second guide RNA molecule includes a targeting domain selected from the group consisting of SEQ ID NO: 4590 to SEQ ID NO: 5277.

In embodiments of the cell, the targeting domain of the first gRNA molecule, the targeting domain of the second gRNA molecule, and, if present, the targeting domain of the third gRNA molecule, include, e.g., consist of, the sequences of any of:

g) Combination A1 to combination A72 of Table 33;
h) Combination B1 to combination B84 of Table 34;
i) Combination C1 to combination C42 of Table 35;
j) Combination D1 to combination D36 of Table 36;
k) Combination E1 to combination E30 of Table 37; or
l) Combination F1 to combination F60 of Table 38.

In embodiments of the cell, the first gRNA molecule includes a targeting domain including SEQ ID NO: 5569, SEQ ID NO: 5592, or SEQ ID NO: 5586, and the second gRNA molecule includes a targeting domain including SEQ ID NO: 5775.

In any of the aforementioned cell aspects and embodiments, a gene including a target sequence complementary to the targeting domain of the first gRNA molecule, and, optionally, a gene including a target sequence complementary to the targeting domain of the second gRNA molecule and/or a gene including a target sequence complementary to the targeting domain of the third gRNA molecule, has been altered such that expression of a functional product of the gene including a target sequence complementary to the targeting domain of the first gRNA molecule, and, optionally, the gene including a target sequence complementary to the targeting domain of the second gRNA molecule and/or a functional product of a gene including a target sequence complementary to the targeting domain of the third gRNA molecule, has been reduced or eliminated.

In another aspect, the invention provides a method of providing an anti-tumor immunity in a subject, the method including administering to the subject an effective amount of a cell as described herein, for example, a cell of any of the aforementioned cell aspects and embodiments.

In another aspect, the invention provides a method of treating cancer in a subject, the method including administering to the subject an effective amount of a cell as described herein, for example, a cell of any of the aforementioned cell aspects and embodiments.

In another aspect, the invention provides a method of treating a subject having a disease associated with expression of a tumor antigen, e.g., a proliferative disease, a precancerous condition, a cancer, and a non-cancer related indication associated with expression of the tumor antigen, the method including administering to the subject an effective amount of a cell as described herein, for example, a cell of any of the aforementioned cell aspects and embodiments. In embodiments, the disease associated with expression of a tumor antigen is cancer or a non-cancer related indication. In embodiments, The disease is cancer selected from colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, combinations of said cancers, and metastatic lesions of said cancers. In embodiments, the cancer is a hematologic cancer selected from the group consisting of chronic lymphocytic leukemia (CLL), acute leukemias, acute lymphoid leukemia (ALL), B-cell acute lymphoid leukemia (B-ALL), T-cell acute lymphoid leukemia (T-ALL), chronic myelogenous leukemia (CML), acute myeloid leukemia (AML), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, and pre-leukemia.

In embodiments of any of the aforementioned methods, the method further includes administering a chemotherapeutic agent, for example, cyclophosphamide, fludarabine, or cyclophosphamide and fludarabine. In embodiments of the methods, the method includes administering a lymphodepleting agent or immunosuppressant prior to administering to the subject an effective amount of the cell as described herein, for example, a cell of any of the aforementioned cell aspects and embodiments.

In another aspect, the invention provides a method of preparing cells (e.g., a population of cells) for immunotherapy, the method including: (a) modifying cells by reducing or eliminating expression of a component of a T-cell receptor (TCR), for example, by introducing into said cells a gRNA molecule (as described herein), e.g., more than one gRNA molecule; (b) modifying cells by reducing or eliminating expression of an FILA (e.g., HLA-A, HLA-B, and/or HLA-C) or B2M, for example, by introducing into said cells a gRNA molecule (as described herein), e.g., more than one gRNA molecule; and (c) expanding said cells. In embodiments, the method further includes modifying said cells by reducing or eliminating expression of CIITA, for example, by introducing into said cells a gRNA molecule (as described herein), e.g., more than one gRNA molecule, wherein said modifying optionally takes place before the step of expanding said cells.

In another aspect, the invention provides a method of preparing cells (e.g., a population of cells) for immunotherapy including: (a) modifying cells by reducing or eliminating expression of a component of a T-cell receptor (TCR), for example, by introducing into said cells a gRNA molecule (as described herein), e.g., more than one gRNA molecule; (b) modifying cells by reducing or eliminating expression of a target for an immunosuppressant, for example, by introducing into said cells a gRNA molecule (as described herein), e.g., more than one gRNA molecule (as described herein); and (c) expanding said cells.

In embodiments of any of the aforementioned methods of preparing cells, the method further includes (d) modifying cells by reducing or eliminating expression of a first inhibitory molecule or downstream effector of signaling through an inhibitory molecule, for example, introducing into said cells a gRNA molecule (as described herein), e.g., more than one gRNA molecule; wherein said modifying optionally takes place before the step of expanding said cells.

In another aspect, the invention provides a method of preparing cells (e.g., a population of cells) for immunotherapy including: (a) modifying cells by reducing or eliminating expression of a first inhibitory molecule or downstream effector of signaling through an inhibitory molecule, for example, by introducing into said cells a gRNA molecule (as described herein), e.g., more than one gRNA molecule; and (c) expanding said cells.

In embodiments of any of the aforementioned methods of preparing cells, the method further includes (e) modifying cells by reducing or eliminating expression of a second inhibitory molecule or downstream effector of signaling through an inhibitory molecule, for example, by introducing into said cells a gRNA molecule, e.g., more than one gRNA molecule, wherein the first inhibitory molecule or downstream effector of signaling through an inhibitory molecule and second inhibitory molecule or downstream effector of signaling through an inhibitory molecule are different.

In embodiments of any of the aforementioned methods of preparing cells, the introduction of each of the gRNA molecules is simultaneous or sequential. In embodiments, the introduction of each of the gRNA molecules is sequential, and separated by a period of at least 24 hours, 2 days, 3 days, 4 days, 5 days, 6 days, 7 days, 8 days, 9 days or 10 days.

In embodiments of any of the aforementioned methods of preparing cells, the method further includes introducing into the cells nucleic acid encoding a chimeric antigen receptor (CAR), e.g., described herein. In embodiments, the nucleic acid encoding a CAR is disposed on a template nucleic acid. In embodiments, the nucleic acid encoding a CAR is disposed on a RNA vector. In embodiments, the nucleic acid encoding a CAR is disposed on a lentiviral vector.

In embodiments of any of the aforementioned methods of preparing cells, the method further includes isolating cells which are negative for TCR expression. In embodiments, the isolating results in a population of cells in which greater than about 75%, for example, greater than about 80%, 85%, 90%, 91%, 92%, 93, 94%, 95%, 96%, 97%, 98%, 99% or 99.5% of the cells are negative for TCR expression. In embodiments, the step of isolating cells which are negative for TCR expression includes contacting the cell population with a composition including an antibody specific for a component of a T cell receptor (TCR), optionally bound to a solid support or detectable label, and isolating the cells which do not bind to said antibody. In embodiments, the cells are immune effector cells, for example, T cells or NK cells, for example, T cells. In embodiments, the cells are allogeneic with respect to a subject to which they are to be administered, for example, the cells are isolated from a healthy donor, e.g., a donor which does not suffer from a condition associated with expression of a tumor antigen. In embodiments, the cells are autologous with respect to a subject to which they are to be administered. In embodiments of any of the aforementioned methods of preparing cells, steps (a) and/or (b) are performed ex vivo. In embodiments, step (c) is performed ex vivo. In embodiments, the expansion of step (c) is performed for a period of at least 2, 3, 4, 5, 6, 7, 8, 9, 10, 11, 12, 13, 14, or 15 days, or for a period of 2-15, 2-14, 2-13, 2-12, 2-11, 2-10, 3-10, 2-9, 3-9, 2-8, 3-8, 2-7, 3-7, 2-6, 3-6, 2-5, or 3-5 days.

In embodiments of any of the aforementioned methods of preparing cells, the gRNA molecules are gRNA molecules described herein, and the targeting domains of each of the gRNA molecules (for example, used in combination) include, for example, consist of, the sequences of any of the combinations listed in Table 33, Table 34, Table 35, Table 36, Table 37 or Table 38. In embodiments the targeting domains of each of the gRNA molecules include, for example, consist, of the sequences of any of:

a) Combination A1 to combination A72 of Table 33, for example, combination A1 to A4, combination A5 to A8, combination A37 to A40, or combination A41 to A44;
b) Combination B1 to combination B84 of Table 34;
c) Combination C1 to combination C42 of Table 35;
d) Combination D1 to combination D36 of Table 36, for example, combination D2, combination D4, combination D20, or combination D22;
e) Combination E1 to combination E30 of Table 37, for example, combination E2, combination E4, combination E8, or combination E10; or
f) Combination F1 to combination F60 of Table 38, for example, any of combination F1 to F4, combination F5 to F8, combination F13 to F16, or combination F17 to F20.

In another aspect, the invention provides a method of treating a subject in need thereof that includes administering cells (e.g., population of cells) prepared by a method of preparing cells described herein, for example, a method of any of the aforementioned aspects and embodiments of methods of preparing cells. In embodiments, particularly in embodiments that include a gRNA molecule which binds to a target sequence of a target for an immunosuppressant, the method further includes administering an immunosuppressive agent, for example, rapamycin, a rapalog or mTor inhibitor, e.g., RAD001. In embodiments, the subject has a disease associated with expression of a tumor antigen, e.g., a proliferative disease, a precancerous condition, a cancer, and a non-cancer related indication associated with expression of the tumor antigen, wherein said administration treats said disease associated with expression of a tumor antigen. In embodiments, the disease associated with expression of a tumor antigen is cancer or a non-cancer related indication. In embodiments, the disease is cancer selected from colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, combinations of said cancers, and metastatic lesions of said cancers. In embodiments, the cancer is a hematologic cancer selected from the group consisting of chronic lymphocytic leukemia (CLL), acute leukemias, acute lymphoid leukemia (ALL), B-cell acute lymphoid leukemia (B-ALL), T-cell acute lymphoid leukemia (T-ALL), chronic myelogenous leukemia (CML), acute myeloid leukemia (AML), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, and pre-leukemia.

In another aspect, the invention provides method of treating a patient suffering from a disease including:
(a) providing a population of cells from an allogeneic donor;
(b) introducing into the cells a CRISPR System (e.g., an S. pyogenes Cas9 CRISPR system) including a first gRNA molecule (or nucleic acid encoding said gRNA molecule) including a targeting domain complementary to a target sequence in a gene selected from CD247, CD3D, CD3E, CD3G, TRAC, TRBC1, and TRBC2;
(c) optionally, selecting those cells in which expression of functional TCR has been reduced or eliminated;
(d) transducing the cells with nucleic acid encoding a CAR; and
(e) administering the cells to a patient in need thereof, e.g., a patient who has a disease associated with expression of an antigen recognized by the CAR. In embodiments, the first gRNA molecule is to CD247, CD3D, CD3E, CD3G, TRAC, TRBC1, or TRBC2.

In embodiments, the method of treating a patient suffering from a disease further includes introducing into the cells a CRISPR System (e.g., an S. pyogenes Cas9 CRISPR system) including a second gRNA molecule (or nucleic acid encoding said gRNA molecule) including a targeting domain complementary to a target sequence in a gene selected from B2M, HLA-A, HLA-B or HLA-C. In embodiments, the second gRNA is to B2M, HLA-A, HLA-B or HLA-C. In embodiments, the method further includes introducing into the cells a CRISPR System (e.g., an S. pyogenes Cas9 CRISPR system) including a third gRNA molecule (or nucleic acid encoding said gRNA molecule) including a targeting domain complementary to a target sequence in a gene selected from CIITA, RFXANK, RFXAP, RFX5, HLA-DM, HLA-DO, HLA-DR, HLA-DQ and HLA-DP.

In other embodiments, the method of treating a patient suffering from a disease further includes introducing into the cells a CRISPR System (e.g., an S. pyogenes Cas9 CRISPR system) including a second gRNA molecule (or nucleic acid encoding said gRNA molecule) including a targeting domain complementary to a target sequence in a gene selected from DCK, CD52, FKBP1A or NR3C1. In embodiments where the second gRNA is to DCK, the method further including administering a nucleoside analog-based drug to said patient, for example, the nucleoside analog-based drug is cytarabine or gemcitabine. In embodiments, where the second gRNA is to CD52, the method further including administering an anti-CD52 antibody or antigen-binding fragment thereof to said patient, for example, the anti-CD52 antibody or antigen-binding fragment thereof is alemtuzumab (CAMPATH®). In embodiments where the second gRNA is to FKBP1A, the method further including administering FK506, cyclosporine, rapamycin or rapalog, or mTor inhibitor such as RAD001, to said patient. In embodiments where the second gRNA is to NR3C1, the method further including administering a corticosteroid to said patient, for example, the corticosteroid is dexamethasone.

In embodiments of any of the aforementioned methods of treating a patient suffering from a disease, the gRNA molecules are gRNA molecules described herein, and the targeting domains of each of the gRNA molecules (for example, used in combination) include, for example, consist of, the sequences of any of the combinations listed in Table 33, Table 34, Table 35, Table 36, Table 37 or Table 38. In embodiments the targeting domains of each of the gRNA molecules include, for example, consist, of the sequences of any of:
a) Combination A1 to combination A72 of Table 33, for example, combination A1 to A4, combination A5 to A8, combination A37 to A40, or combination A41 to A44;
b) Combination B1 to combination B84 of Table 34;
c) Combination C1 to combination C42 of Table 35;
d) Combination D1 to combination D36 of Table 36, for example, combination D2, combination D4, combination D20, or combination D22;
e) Combination E1 to combination E30 of Table 37, for example, combination E2, combination E4, combination E8, or combination E10; or
f) Combination F1 to combination F60 of Table 38, for example, any of combination F1 to F4, combination F5 to F8, combination F13 to F16, or combination F17 to F20.

In embodiments of any of the aforementioned methods of treating a patient suffering from a disease, the method further includes introducing into the cells a CRISPR System (e.g., an *S. pyogenes* Cas9 CRISPR system) including a fourth gRNA molecule (or nucleic acid encoding said gRNA molecule) including a targeting domain complementary to a target sequence in a gene selected from CD274, HAVCR2, LAG3, PDCD1, PD-L2, CTLA4, CEACAM (e.g., CEACAM-1, CEACAM-3 and/or CEACAM-5), VISTA, BTLA, TIGIT, LAIR1, CD160, 2B4, CD80, CD86, B7-H3 (CD113), B7-H4 (VTCN1), HVEM (TNFRSF14 or CD107), KIR, A2aR, MHC class I, MHC class II, GAL9, adenosine, and TGF beta, or PTPN11, for example, a fourth gRNA molecule is to CD274, HAVCR2, LAG3, PDCD1 or PTPN11.

In another aspect, the invention provides a method of treating a patient suffering from a disease including:
(a) providing a population of cells (as described herein), for example, immune effector cells;
(b) introducing into the population of cells a CRISPR System (e.g., an *S. pyogenes* Cas9 CRISPR system) including a first gRNA molecule (or nucleic acid encoding said gRNA molecule) including a targeting domain complementary to a target sequence in a gene selected from CD247, CD3D, CD3E, CD3G, TRAC, TRBC1, and TRBC2;
(c) introducing into the population of cells a CRISPR System (e.g., an *S. pyogenes* Cas9 CRISPR system) including a second gRNA molecule (or nucleic acid encoding said gRNA molecule) including a targeting domain complementary to a target sequence in a gene selected from B2M, HLA-A, HLA-B and HLA-C;
(d) optionally, selecting those cells in which expression of functional TCR, functional B2M, or both functional TCR and B2M has been reduced or eliminated;
(d) introducing into the population of cells a nucleic acid encoding a CAR; and
(e) administering the population of cells to a patient in need thereof, e.g., a patient who has a disease associated with expression of an antigen recognized by the CAR. In embodiments of the method, the method further comprises (f) introducing into the population of cells a CRISPR System (e.g., an *S. pyogenes* Cas9 CRISPR system) including a third gRNA molecule (or nucleic acid encoding said gRNA molecule) including a targeting domain complementary to a target sequence in a gene selected from CIITA, RFXANK, RFX5, and RFXAP. In embodiments, the first gRNA molecule includes a targeting domain complementary to a target sequence in a gene selected from TRAC, TRBC1 and TRBC2, for example, as described herein, for example, TRAC, for example, includes (for example consists of) a targeting domain selected from SEQ ID NO: 5569, SEQ ID NO: 5585, SEQ ID NO: 5592, SEQ ID NO: 5601, SEQ ID NO: 5589, SEQ ID NO: 5600, SEQ ID NO: 5594, SEQ ID NO: 5571, SEQ ID NO: 5593, SEQ ID NO: 5574, SEQ ID NO: 5598, SEQ ID NO: 5586, SEQ ID NO: 5599, SEQ ID NO: 5591, SEQ ID NO: 5610, SEQ ID NO: 5608, SEQ ID NO: 5617, SEQ ID NO: 5619, and SEQ ID NO: 5620, for example, selected from SEQ ID NO: 5569, SEQ ID NO: 5592, SEQ ID NO: 5587, SEQ ID NO: 5599, SEQ ID NO: 5600, and SEQ ID NO: 5586, e.g., selected from SEQ ID NO: 5569, SEQ ID NO: 5586, and SEQ ID NO: 5592. In other embodiments, the first gRNA molecule includes a targeting domain complementary to a target sequence in a gene selected from CD3E, CD3G and CD3D, for example, as described herein. In embodiments, the second gRNA molecule includes a targeting domain complementary to a target sequence in a B2M gene, for example, as described herein, for example, including (for example consisting of) a targeting domain selected from SEQ ID NO: 5519, SEQ ID NO: 5497, SEQ ID NO: 5499, SEQ ID NO: 5498, SEQ ID NO: 5503, SEQ ID NO: 5496, SEQ ID NO: 5507, SEQ ID NO: 5515, SEQ ID NO: 5493, SEQ ID NO: 5506, SEQ ID NO: 5509, SEQ ID NO: 5517, SEQ ID NO: 5521, SEQ ID NO: 5520, SEQ ID NO: 5500, SEQ ID NO: 5494, SEQ ID NO: 5508, SEQ ID NO: 5514, and SEQ ID NO: 5492, for example, selected from SEQ ID NO: 5496, SEQ ID NO: 5498 and SEQ ID NO: 5509. In embodiments, the third gRNA molecule includes a targeting domain complementary to a target sequence in a CIITA gene, for example, as described herein, for example, including (for example consisting of) a targeting domain selected from SEQ ID NO: 7771, SEQ ID NO: 7769, SEQ ID NO: 7773, SEQ ID NO: 7726, SEQ ID NO: 7758, SEQ ID NO: 7739, SEQ ID NO: 7779, SEQ ID NO: 7770, SEQ ID NO: 7749, SEQ ID NO: 7754, SEQ ID NO: 7745, SEQ ID NO: 7785, SEQ ID NO: 7731, SEQ ID NO: 7772, SEQ ID NO: 7743, or SEQ ID NO: 7750, for example, selected from SEQ ID NO: 7769, SEQ ID NO: 7771, SEQ ID NO: 7739 or SEQ ID NO: 7785. In preferred embodiments, the targeting domains of each of the gRNA molecules (for example, used in combination) include, for example, consist of, the sequences of any of the combinations listed in Table 33, Table 34, or Table 38. In embodiments the targeting domains of each of the gRNA molecules include, for example, consist, of the sequences of any of:
a) Combination A1 to combination A72 of Table 33, for example, combination A1 to A4, combination A5 to A8, combination A37 to A40, or combination A41 to A44;
b) Combination B1 to combination B84 of Table 34; or
c) Combination F1 to combination F60 of Table 38, for example, any of combination F1 to F4, combination F5 to F8, combination F13 to F16, or combination F17 to F20.

In embodiments of the method of treating a patient suffering from a disease, the method further includes introducing into said cells a nucleic acid molecule encoding an NK inhibitory molecule (e.g., as described herein), e.g., a nucleic acid molecule encoding an HLA-G:B2M fusion, e.g., a nucleic acid molecule encoding SEQ ID NO: 10674. In embodiments of the method of treating a patient suffering from a disease the cell (or population of cells) is an immune effector cell (or population of immune effector cells), for example, a T cell (or population of T cells). In embodiments, the cell (or population of cells) is allogeneic relative to the patient, for example, is isolated from a healthy human donor. In other embodiments, the cell (or population of cells) is autologous relative to the patient. In embodiments, the CAR is a CD19 CAR (for example, described herein), for example, a CD19 CAR including an antigen binding domain including any one of SEQ ID NO: 7883 to SEQ ID NO: 7898. In other embodiments, the CAR is a BCMA CAR, for example, including an antigen recognition domain including any one of SEQ ID NO: 7939 to SEQ ID NO: 8112 or SEQ ID NO: 8155 to SEQ ID NO: 8166, e.g., includes an antigen recognition domain including, e.g., consisting of, SEQ ID NO: 7949, for example, including any one of SEQ ID NO: 8549 to SEQ ID NO: 8621, e.g., including, e.g., consisting of, SEQ ID NO: 8559.

In another aspect, the invention provides a modified cell, which has reduced or eliminated expression of: a) a component of the T cell receptor; b) B2M; and/or c) CIITA, relative to an unmodified cell of the same type. In embodiments, the component of the T cell receptor is a TCR alpha chain or a TCR beta chain, for example, the TCR alpha chain. In other embodiments, the component of the TCR is CD3 delta, CD3 epsilon, or CD3 gamma, e.g., is CD3 epsilon. In embodiments, the modified cell (or population of cells) has reduced or eliminated expression of a component of the T cell receptor, B2M and CIITA.

In another aspect, the invention provides a modified cell, including an insertion or deletion of a base pair, e.g., more than one base pair, at or near: a) a gene encoding a component of the T cell receptor; b) B2M; and/or c) CIITA; relative to an unmodified cell of the same type. In embodiments, each of said insertions or deletions is an indel. In embodiments, each of said insertion or deletion is a frameshift mutation. In embodiments, the modified cell (or population of cells) an insertion or deletion of a base pair, e.g., more than one base pair, at or near a gene encoding a component of the T cell receptor, B2M and CIITA.

In another aspect, the invention provides a population of cells including the modified cell of any the aforementioned cell (e.g., modified cell) aspects and embodiments, wherein in at least about 30% of the cells, at least one said insertion or deletion is a frameshift mutation, e.g., as measured by NGS.

In another aspect, the invention provides a cell including (e.g., a population of cells including a cell, e.g., more than one cell, including):
  (a) Nucleic acid sequence encoding a CAR, e.g., as described herein;
  (b) Optionally, nucleic acid sequence encoding an NK inhibitory molecule, e.g., as described herein, e.g., nucleic acid encoding an HLA-G or HLA-G:B2M fusion as described herein;
  (c) An indel at or near a sequence of a gene encoding a component of a TCR (e.g., TRAC, TRBC1 TRBC2, CD3E, CD3D or CD3G, e.g. TRAC) or its regulatory elements, e.g., an indel at or near a target sequence of a gRNA including a targeting domain to a component of a TCR (e.g., TRAC, TRBC1, TRBC2, CD3E, CD3D, or CD3G e.g. TRAC), e.g., including a targeting domain listed in Table 1, Table 4, Table 5, Table 6e, Table 6f, or Table 6g;
  (d) An indel at or near a sequence of the gene encoding B2M or its regulatory elements, e.g., an indel at or near a target sequence of a gRNA including a targeting domain to B2M, e.g., including a targeting domain listed in Table 1 or Table 3;
  (e) Optionally, an indel at or near a sequence of the gene encoding CIITA or its regulatory elements, e.g., an indel at or near a target sequence of a gRNA including a targeting domain to CIITA, e.g., including a targeting domain listed in Table 1 or Table 6c; and
  (f) Optionally, an indel at or near a sequence of the gene encoding LILRB1 or its regulatory elements, e.g., an indel at or near a target sequence of a gRNA including a targeting domain to LILRB1, e.g., including a targeting domain listed in Table 6d;

Wherein the cell (or population of cells including said cell) expresses the CAR and, optionally, the NK inhibitory molecule, and exhibits reduced or eliminated expression and/or function of one or more of: i) a component of a TCR (e.g., TRAC, TRBC1 TRBC2, CD3D, CD3E or CD3G, e.g. TRAC), ii) B2M, iii) CIITA, and/or iv) LILRB1. In embodiments the targeting domain sequences of the gRNA molecules (as described herein) to a component of a TCR, B2M and CIITA include, for example, consist of the targeting domains listed in any combination listed in Table 33, Table 34 or Table 38, for example,
  a) Combination A1 to combination A72 of Table 33, for example, combination A1 to A4, combination A5 to A8, combination A37 to A40, or combination A41 to A44;
  b) Combination B1 to combination B84 of Table 34; or
  c) Combination F1 to combination F60 of Table 38, for example, any of combination F1 to F4, combination F5 to F8, combination F13 to F16, or combination F17 to F20.

In another aspect, the invention provides a cell including (e.g., a population of cells including a cell, e.g., more than one cell, including):
  (a) Nucleic acid sequence encoding a CAR, e.g., as described herein;
  (b) Optionally, nucleic acid sequence encoding an NK inhibitory molecule, e.g., as described herein, e.g., nucleic acid encoding an HLA-G as described herein;
  (c) An indel at or near a sequence of a gene encoding a component of a TCR (e.g., TRAC, TRBC1 TRBC2, CD3D, CD3E or CD3G, e.g. TRAC) or its regulatory elements, e.g., an indel at or near a target sequence of a gRNA including a targeting domain to a component of a TCR (e.g., TRAC, TRBC1 TRBC2, CD3D, CD3E or CD3G, e.g. TRAC), e.g., including a targeting domain listed in Table 1, Table 4, Table 5, Table 6e, Table 6f, or Table 6g;
  (d) An indel at or near a sequence of the gene encoding NLRC5 or its regulatory elements, e.g., an indel at or near a target sequence of a gRNA including a targeting domain to NLRC5, e.g., including a targeting domain listed in Table 1;
  (e) Optionally, an indel at or near a sequence of the gene encoding CIITA or its regulatory elements, e.g., an indel at or near a target sequence of a gRNA including a targeting domain to CIITA, e.g., including a targeting domain listed in Table 1 or Table 6c; and
  (f) Optionally, an indel at or near a sequence of the gene encoding LILRB1 or its regulatory elements, e.g., an indel at or near a target sequence of a gRNA including a targeting domain to LILRB1, e.g., including a targeting domain listed in Table 6d;

Wherein the cell (or population of cells including one or more of said cells) expresses the CAR and, optionally, the NK inhibitory molecule, and exhibits reduced or eliminated expression and/or function of one or more of: i) a component of a TCR (e.g., TRAC, TRBC1 TRBC2, CD3D, CD3E or CD3G, e.g. TRAC), ii) B2M, iii) NLRC5, and/or iv) LILRB1.

In another aspect, the invention provides a cell including (e.g., a population of cells including a cell, e.g., more than one cell, including):
  (a) Nucleic acid sequence encoding a CAR, e.g., as described herein;
  (b) An indel at or near a sequence of a gene encoding a component of a TCR (e.g., TRAC, TRBC1 TRBC2, CD3D, CD3E or CD3G, e.g. TRAC) or its regulatory elements, e.g., an indel at or near a target sequence of a gRNA including a targeting domain to a component of a TCR (e.g., TRAC, TRBC1 TRBC2, CD3D, CD3E or CD3G, e.g. TRAC), e.g., including a targeting domain listed in Table 1, Table 4, Table 5, Table 6e, Table 6f, or Table 6g; and
  (c) An indel at or near a sequence of the gene encoding FKBP1A or its regulatory elements, e.g., an indel at or near a target sequence of a gRNA including a targeting domain to FKBP1A, e.g., including a targeting domain listed in Table 1 or Table 6b;
Wherein the cell (or population of cells including a cell, e.g., more than one cell, including) expresses the CAR, and exhibits reduced or eliminated expression and/or function of one or more of: i) a component of a TCR (e.g., TRAC, TRBC1 TRBC2, CD3D, CD3E or CD3G, e.g. TRAC), and/or ii) FKBP12. In embodiments the targeting domain sequences of the gRNA molecules (as described herein) to a component of a TCR and FKBP1A include, for example, consist of the targeting domains listed in any combination listed in Table 35, Table 36 or Table 37, for example
  a) Combination C1 to combination C42 of Table 35;
  b) Combination D1 to combination D36 of Table 36, for example, combination D2, combination D4, combination D20, or combination D22; or
  c) Combination E1 to combination E30 of Table 37, for example, combination E2, combination E4, combination E8, or combination E10.

In another aspect, the invention provides a cell including (e.g., a population of cells including a cell, e.g., more than one cell, including):
  (a) Nucleic acid sequence encoding a CAR, e.g., as described herein;
  (b) Nucleic acid sequence encoding a rapamycin-resistant mTor, e.g., as described herein, e.g., nucleic acid sequence encoding an mTor including a S2035 mutation, e.g., an S20351 mutation; and;
  (c) An indel at or near a sequence of a gene encoding a component of a TCR (e.g., TRAC, TRBC1 TRBC2, CD3D, CD3E or CD3G, e.g. TRAC) or its regulatory elements, e.g., an indel at or near a target sequence of a gRNA including a targeting domain to a component of a TCR (e.g., TRAC, TRBC1 TRBC2, CD3D, CD3E or CD3G, e.g. TRAC), e.g., including a targeting domain listed in Table 1, Table 4, Table 5, Table 6e, Table 6f, or Table 6g;
Wherein the cell (or population of cells including said cell, e.g., more than one of said cell) expresses the CAR and the rapamycin-resistant mTor, and exhibits reduced or eliminated expression and/or function of a component of a TCR (e.g., TRAC, TRBC1 TRBC2, CD3D, CD3E or CD3G, e.g. TRAC).

In embodiments, that include an indel at or near a gene encoding a component of the TCR, B2M and CIITA, the targeting domain of the gRNA molecule to a component of the TCR, the targeting domain of the gRNA molecule to B2M, and the targeting domain of the gRNA molecule to CIIRA comprise, e.g., consists of, respectively: a) the targeting domain sequences for said gRNA molecules listed in any combination of A1 to A72 in Table 33; b) the targeting domain sequences for said gRNA molecules listed in any combination of F1 to F60 in Table 38; or c) the targeting domain sequence for each gRNA molecule listed in any combination of B1 to B84 in Table 34.

In embodiments, that include an indel at or near a gene encoding a component of the TCR and FKBP1A, the targeting domain of the gRNA molecule to a component of the TCR, and the targeting domain of the gRNA molecule(s) to FKBP1A comprise, e.g., consists of, respectively, a) the targeting domain sequences for said gRNA molecules listed in any combination of C1 to C42 in Table 35; b) the targeting domain sequences for said gRNA molecules listed in any combination of D1 to D36 in Table 36; or c) the targeting domain sequences for said gRNA molecules listed in any combination of E1 to E30 in Table 37.

In embodiments of any of the cell aspects and embodiments described above, each of said indels in said cell is made by introducing into said cell a gRNA molecule, e.g., more than one gRNA molecule, (e.g., a CRISPR system, e.g., more than one CRISPR system, including said gRNA molecule, e.g., each of said more than one gRNA molecules), each including a targeting domain which is complementary to a target sequence at or near each of said indels.

In another aspect, the invention provides a population of cells, wherein at least about 30%, for example, at least about 50%, for example, at least about 75%, for example, at least about 90% of the cells of the population are a cell of any of the aforementioned cell aspects or embodiments. In embodiments, in at least about 30% of said cells (e.g., in at least about 40%, e.g., in at least about 50%, e.g., in at least about 60%, e.g., in at least about 70%, e.g., in at least about 80%, e.g., in at least about 90%, e.g., in at least about 95%, e.g., in at least about 99% of said cells), each of said indels is a frameshift mutation. In embodiments, including in any of the aforementioned cell aspects and embodiments, the invention provides a cell (or population of cells) that includes an indel listed in FIG. 34A, FIG. 34B or FIG. 49. In embodiments, including in any of the aforementioned cell aspects and embodiments, the invention provides a cell (or population of cells) that includes an indel listed in FIG. 36 or FIG. 48. In embodiments, including in any of the aforementioned cell aspects and embodiments, the invention provides a cell (or population of cells) that includes an indel listed in FIG. 38, FIG. 41, FIG. 44 or FIG. 50. In embodiments, including in any of the aforementioned cell aspects and embodiments, the invention provides a cell (or population of cells) that includes an indel listed in FIG. 53.

In another aspect, the invention provides a population of cells that include a cell of any of the aforementioned cell aspects and embodiments. In embodiments, at least about 20% of the cells of the population of cells is a cell of any of the aforementioned cell aspects and embodiments. In embodiments, at least about 50% of the cells of the population of cells is a cell of any of the aforementioned cell aspects and embodiments. In embodiments, less than about 5%, e.g., less than about 1%, e.g., less than about of the cells of the population of cells includes an off-target indel. In embodiments, the cell of the population of cells is engineered to express a chimeric antigen receptor (CAR). In embodiments, the CAR is a CD19 CAR (for example, described herein), for example, a CD19 CAR including an antigen binding domain including any one of SEQ ID NO: 7883 to SEQ ID NO: 7898, or includes the sequence of SEQ ID NO: 7909 or SEQ ID NO: 7920. In other embodiments, the CAR is a BCMA CAR, for example, including an antigen recognition domain including any one of SEQ ID NO: 7939 to SEQ ID NO: 8112 or SEQ ID NO: 8155 to SEQ ID NO: 8166, e.g., including an antigen recognition domain including, e.g., consisting of, SEQ ID NO: 7949, for example, including any one of SEQ ID NO: 8549 to SEQ ID NO: 8621, e.g., including, e.g., consisting of, SEQ ID NO: 8559. In embodiments, the cell is an animal cell, for example, a mammalian, primate, or human cell, e.g., a human cell. In embodiments, the cell is an immune effector cell (e.g., a population of immune effector cells), for example, a T cell or NK cell, for example, a T cell, for example, a CD4+ T cell, a CD8+ T cell, or a combination thereof. In embodiments, the cell is allogeneic relative to a patient to be administered said cell, for example, the cell is isolated from a healthy human subject. In other embodiments, the cell is autologous relative to a patient to be administered said cell.

In another aspect, the invention provides a method of treating a disease, e.g., a cancer, in a patient in need thereof, including administering the cell of any of the aforementioned cell aspects and embodiments. In embodiments, particularly in embodiments in which expression or function of a target for an immunosuppressant has been reduced or eliminated, the method further includes administering an immunosuppressant, e.g., RAD001.

In another aspect, the invention provides a gRNA molecule as described herein (for example in any of the aforementioned gRNA molecule aspects and embodiments), a composition as described herein (for example in any of the aforementioned composition aspects and embodiments), a nucleic acid as described herein (for example in any of the aforementioned nucleic acid aspects and embodiments), a vector as described herein (for example in any of the aforementioned vector aspects and embodiments), or a cell (or population of cells) as described herein (for example in any of the aforementioned cell (e.g., modified cell) or population of cells aspects and embodiments), for use as a medicament.

In another aspect, the invention provides a gRNA molecule as described herein (for example in any of the aforementioned gRNA molecule aspects and embodiments), a composition as described herein (for example in any of the aforementioned composition aspects and embodiments), a nucleic acid as described herein (for example in any of the aforementioned nucleic acid aspects and embodiments), a vector as described herein (for example in any of the aforementioned vector aspects and embodiments), or a cell (or population of cells) as described herein (for example in any of the aforementioned cell (e.g., modified cell) or population of cells aspects and embodiments), for use in the manufacture of a medicament.

In another aspect, the invention provides a gRNA molecule as described herein (for example in any of the aforementioned gRNA molecule aspects and embodiments), a composition as described herein (for example in any of the aforementioned composition aspects and embodiments), a nucleic acid as described herein (for example in any of the aforementioned nucleic acid aspects and embodiments), a vector as described herein (for example in any of the aforementioned vector aspects and embodiments), or a cell (or population of cells) as described herein (for example in any of the aforementioned cell (e.g., modified cell) or population of cells aspects and embodiments), for use in the treatment of a disease.

In another aspect, the invention provides a gRNA molecule as described herein (for example in any of the aforementioned gRNA molecule aspects and embodiments), a composition as described herein (for example in any of the aforementioned composition aspects and embodiments), a nucleic acid as described herein (for example in any of the aforementioned nucleic acid aspects and embodiments), a vector as described herein (for example in any of the aforementioned vector aspects and embodiments), or a cell (or population of cells) as described herein (for example in any of the aforementioned cell (e.g., modified cell) or population of cells aspects and embodiments), for use in the treatment of a disease, wherein the disease is a disease associated with expression of a tumor antigen, e.g., a proliferative disease, a precancerous condition, a cancer, and a non-cancer related indication associated with expression of the tumor antigen.

In another aspect, the invention provides a gRNA molecule as described herein (for example in any of the aforementioned gRNA molecule aspects and embodiments), a composition as described herein (for example in any of the aforementioned composition aspects and embodiments), a nucleic acid as described herein (for example in any of the aforementioned nucleic acid aspects and embodiments), a vector as described herein (for example in any of the aforementioned vector aspects and embodiments), or a cell (or population of cells) as described herein (for example in any of the aforementioned cell (e.g., modified cell) or population of cells aspects and embodiments), for use in the treatment of a cancer, wherein the cancer is a hematologic cancer selected from the group consisting of chronic lymphocytic leukemia (CLL), acute leukemias, acute lymphoid leukemia (ALL), B-cell acute lymphoid leukemia (B-ALL), T-cell acute lymphoid leukemia (T-ALL), chronic myelogenous leukemia (CML), acute myeloid leukemia (AML), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, and pre-leukemia.

In another aspect, the invention provides a gRNA molecule as described herein (for example in any of the aforementioned gRNA molecule aspects and embodiments), a composition as described herein (for example in any of the aforementioned composition aspects and embodiments), a nucleic acid as described herein (for example in any of the aforementioned nucleic acid aspects and embodiments), a vector as described herein (for example in any of the aforementioned vector aspects and embodiments), or a cell (or population of cells) as described herein (for example in any of the aforementioned cell (e.g., modified cell) or population of cells aspects and embodiments), for use in the treatment of a cancer, e.g., wherein the cancer is selected from the group consisting of mesothelioma, adenocarcinoma, glioblastoma, colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, combinations of said cancers, and metastatic lesions of said cancers.

In addition to the specific features of the invention described above, it is contemplated that the following general features of gRNA molecules, Cas9 molecules and cells are applicable to any aspect and embodiment of the invention described herein, including those aspects and embodiments described above.

In any of the aspects and embodiments disclosed herein, the gRNA molecule (e.g., the gRNA molecule, or combination of gRNA molecules, including a targeting domain described herein) may include one or more of the following features:

In certain embodiments, the gRNA molecule (e.g., the gRNA molecule, or one or more gRNA molecules of a combination of gRNA molecules, including a targeting domain described herein) is a dgRNA molecule, wherein the targeting domain and the tracr are disposed on separate nucleic acid molecules. In embodiments, the crRNA includes, from 5' to 3', [targeting domain]—:

a) SEQ ID NO: 6584;
b) SEQ ID NO: 6585;
c) SEQ ID NO: 6605;
d) SEQ ID NO: 6606;
e) SEQ ID NO: 6607;
f) SEQ ID NO: 6608; or
g) SEQ ID NO: 7806. In a preferred embodiment, the crRNA includes, from 5' to 3', [targeting domain]-[SEQ ID NO: 6607]. In embodiments, the tracr includes more than 15, e.g., 20 or more, 30 or more, 40 or more, 50 or more, 60 or more, 70 or more, or 80 or more, nucleotides of the *S. Pyogenes* tracr sequence (GUUG-GAACCAUUCAAAACAG-CAUAGCAAGUUAAAAUAAGGCUAGU-CCGUUAUCAACUUG AAAAAGUGGCACCGAGUCGGUGC). In embodiments, the tracr additionally includes 1 or more, e.g., 1, 2, 3, 4, 5, 6, or 7, e.g., preferably 4 or 7, U nucleotides at the 3' end. In preferred dgRNA embodiments, the tracr includes SEQ ID NO: 7820. In embodiments, the tracr additionally includes 1 or more, e.g., 1, 2, 3, 4, 5, 6, or 7, e.g., preferably 4 or 7, U nucleotides at the 3' end. In preferred dgRNA embodiments, the tracr includes, e.g., consists of, SEQ ID NO: 6660. In preferred dgRNA embodiments, the crRNA includes, e.g., consists of, [targeting domain]-SEQ ID NO: 6607, and the tracr includes SEQ ID NO: 7820, e.g., includes, e.g., consists of, SEQ ID NO: 6660.

In other embodiments, the gRNA molecule (e.g., the gRNA molecule, or one or more gRNA molecules of a combination of gRNA molecules, including a targeting domain described herein) is a sgRNA molecule, wherein the targeting domain and the tracr are disposed a single nucleic acid molecule. In embodiments, the sgRNA molecule includes, e.g., consists of: [targeting domain]—

(a) SEQ ID NO: 6601;
(b) SEQ ID NO: 6602;
(c) SEQ ID NO: 6603;
(d) SEQ ID NO: 6604; or
(e) any of (a) to (d), above, further including, at the 3' end, 1, 2, 3, 4, 5, 6 or 7 uracil (U) nucleotides. In a preferred embodiment, the sgRNA molecule includes [targeting domain]-SEQ ID NO: 6601. In a preferred embodiment, the sgRNA molecule includes, e.g., consists of, [targeting domain]-SEQ ID NO: 7811.

In embodiments, including in any of the aforementioned aspects and embodiments, one or more of the nucleic acid molecules of the gRNA molecule described herein, e.g., all of the nucleic acid molecules of the gRNA molecule described herein, do not include a modification to a nucleotide or internucleotide bond. In other embodiments, including in any of the aforementioned aspects and embodiments, one or more of the nucleic acid molecules of the gRNA molecule described herein include one or more modifications to a nucleotide or internucleotide bond, e.g. as described herein. In embodiments, said modification includes a 2' O-methyl modification. In embodiments, said modification includes a phosphorothioate modification. In embodiments, said modification includes a 2' O-methyl modification at each of the 1, 2, 3 or more, e.g., 3, 3' nucleotides of the nucleic acid of the gRNA molecule. In embodiments, said modification includes a 2' O-methyl modification at each of the $4^{th}$-to-terminal, $3^{rd}$-to-terminal, and $2^{nd}$-to-terminal 3' nucleotides of the nucleic acid of the gRNA molecule. In embodiments, said modification includes a 2' O-methyl modification at each of the 1, 2, 3 or more, e.g., 3, 5' nucleotides of the nucleic acid of the gRNA molecule. In embodiments, said modification includes a 2' O-methyl modification at each of the $4^{th}$-to-terminal, $3^{rd}$-to-terminal, and $2^{nd}$-to-terminal 3' nucleotides of the nucleic acid of the gRNA molecule, and a 2' O-methyl modification at each of the 1, 2, 3 or more, e.g., 3, 5' nucleotides of the nucleic acid of the gRNA molecule. In embodiments, said modification includes one or more, e.g., 1, 2, 3, or more, e.g., 3, phosphorothioate bonds at the 3' end of the nucleic acid molecule of the gRNA. In embodiments, said modification includes one or more, e.g., 1, 2, 3, or more, e.g., 3, phosphorothioate bonds at the 5' end of the nucleic acid molecule of the gRNA. In embodiments, said modification includes one or more, e.g., 1, 2, 3, or more, e.g., 3, phosphorothioate bonds at the 3' end and at the 5' end of the nucleic acid molecule of the gRNA. In embodiments involving a dgRNA molecule, both the molecule including the tracr and the molecule including the crRNA are modified as described herein. In other embodiments involving a dgRNA molecule, the molecule including the tracr is unmodified, and the molecule including the crRNA is modified as described herein. In other embodiments involving a dgRNA molecule, the molecule including the crRNA is unmodified, and the molecule including the tracr is modified as described herein.

In aspects of the invention that include more than one gRNA molecule, each gRNA molecule can independently be a dgRNA molecule or a sgRNA molecule, e.g., as described herein. In embodiments, all of the gRNA molecules of a combination described herein are dgRNA molecules. In embodiments, all of the gRNA molecules of a combination described herein are sgRNA molecules. In embodiments, one or more of the gRNA molecules of a combination described herein are dgRNA molecules, and one or more of the other gRNA molecules of a combination described herein are sgRNA molecules.

In embodiments, the gRNA molecule of the invention is a gRNA molecule that produces an indel at or near the target sequence of the gRNA when introduced into a cell described herein. In embodiments, the gRNA molecule of the invention is a gRNA molecule that produces an indel in at least about 70%, e.g., at least about 80%, e.g., at least about 90%, e.g., at least about 95%, e.g., at least about 96%, e.g., at least about 97%, e.g., at least about 98%, e.g., at least about 99%, or more, of the cells, e.g., as described herein, of a population of cells to which the gRNA molecule is introduced. In embodiments, the indel frequency is measured by NGS, e.g., as described herein. In embodiments, said indel or indels are or include frameshift mutations. In embodiments, the gRNA molecule of the invention is a gRNA molecule that produces a frameshift mutation in at least about 30%, e.g., at least about 40%, e.g., at least about 50%, e.g., at least about 60%, e.g., at least about 70%, e.g., at least about 75%, e.g., at least about 80%, e.g., at least about 85%, e.g., at least about 90%, e.g., at least about 95%, or more, of the cells, e.g., as described herein, of a population of cells to which the gRNA molecule is introduced. In embodiments, the frameshift mutation frequency is measured by NGS, e.g., as described herein. In embodiments, said indel, indel frequency, frameshift mutation and/or frameshift mutation frequency is measured in the cell (or population or cells) after introduction of the gRNA molecule as an RNP with a Cas9 molecule described herein. In embodiments, said indel, indel frequency, frameshift mutation and/or frameshift mutation frequency is measured in the cell (or population or cells) after introduction of the gRNA molecule by electroporation.

In embodiments, the gRNA molecule of the invention is a gRNA molecule that produces an indel at an off-target site with at least a 50-fold, e.g., at least 100-fold, e.g., at least 1000-fold, lower frequency than at or near the target sequence of the gRNA, when introduced into a cell or population of cells described herein. In preferred embodiments, the gRNA does not produce a detectable indel at any off-target site when introduced into a cell or population of cells described herein. In embodiments, the off-target indel analysis is measured by targeted off-target sequencing of predicted off-target binding sites, e.g., as described herein. In embodiments, off-target indel analysis is measured by nucleotide insertional analysis, e.g., as described herein. In embodiments, the off-target analysis is measured in the cell (or population or cells) after introduction of the gRNA molecule as an RNP with a Cas9 molecule described herein. In embodiments, the off-target analysis is measured in the cell (or population or cells) after introduction of the gRNA molecule by electroporation.

In embodiments, the RNP or combination of RNPs is delivered to the cells by a single electroporation. In embodiments the cells of the invention are subjected to only a single electroporation step.

In aspects and embodiments of the invention that include a combination of gRNA molecules, each of the gRNA molecules of the combination can independently include any of the aforementioned features.

In any of the aspects and embodiments disclosed herein, the Cas9 molecule may include one or more of the following features:

In aspects the Cas9 molecule is an *S. Pyogenes* Cas9, e.g., a modified or unmodified *S. Pyogenes* Cas9 molecule as described herein. In embodiments, the Cas9 molecule includes SEQ ID NO: 6611. In other embodiments, the Cas9 molecule includes, e.g., consists of, SEQ ID NO: 7821. In other embodiments, the Cas9 molecule includes, e.g., consists of, SEQ ID NO: 7822. In other embodiments, the Cas9 molecule includes, e.g., consists of, SEQ ID NO: 7823. In other embodiments, the Cas9 molecule includes, e.g., consists of, SEQ ID NO: 7824. In other embodiments, the Cas9 molecule includes, e.g., consists of, SEQ ID NO: 7825. In other embodiments, the Cas9 molecule includes, e.g., consists of, SEQ ID NO: 7826. In other embodiments, the Cas9 molecule includes, e.g., consists of, SEQ ID NO: 7827. In other embodiments, the Cas9 molecule includes, e.g., consists of, SEQ ID NO: 7828. In other embodiments, the Cas9 molecule includes, e.g., consists of, SEQ ID NO: 7829. In other embodiments, the Cas9 molecule includes, e.g., consists of, SEQ ID NO: 7830. In other embodiments, the Cas9 molecule includes, e.g., consists of, SEQ ID NO: 7831. Preferred Cas9 molecules are Cas9 molecules that include, e.g., consist of, SEQ ID NO: 7821, SEQ ID NO: 7822, SEQ ID NO: 7825 and SEQ ID NO: 7828.

In aspects and embodiments that include one or more RNP complexes, e.g., one or more RNP complexes that include a Cas9 molecule described herein, each of said RNP complexes is at a concentration of less than about 10 uM, e.g., less than about 3 uM, e.g., less than about 1 uM, e.g., less than about 0.5 uM, e.g., less than about 0.3 uM, e.g., less than about 0.1 uM. In embodiments, said concentration is the concentration of the RNP complex in the composition including the cell (e.g., population of cells), e.g., as described herein, to which the RNP is to be introduced, e.g., as described herein, e.g., by electroporation. In embodiments, the media of the composition is suitable for electroporation.

In aspects and embodiments of the invention that include a combination of gRNA molecules, for example a combination of RNPs that include different gRNA molecules, each of the Cas9 molecules of the combination can independently include any of the aforementioned features.

In any of the aspects and embodiments disclosed herein, the cell (e.g., population of cells) may include one or more of the following features:

In aspects, the cell (e.g., population of cells) includes one or more cells that have reduced or eliminated expression of a component of the T-cell receptor (TCR). In embodiments, the reduced or eliminated expression of a component of the T-cell receptor (TCR) includes reduced or eliminated expression of TRAC. In embodiments, the reduced or eliminated expression of a component of the T-cell receptor (TCR) includes reduced or eliminated expression of TRBC1. In embodiments, the reduced or eliminated expression of a component of the T-cell receptor (TCR) includes reduced or eliminated expression of TRBC2. In embodiments, the reduced or eliminated expression of a component of the T-cell receptor (TCR) includes reduced or eliminated expression of CD3G. In embodiments, the reduced or eliminated expression of a component of the T-cell receptor (TCR) includes reduced or eliminated expression of CD3D. In embodiments, the reduced or eliminated expression of a component of the T-cell receptor (TCR) includes reduced or eliminated expression of CD3E. In embodiments, said reduced or eliminated expression of said component of the TCR is the result of introduction of one or more, e.g., one or two, e.g., one gRNA molecule described herein to said component of the TCR into said cell. In embodiments, the cell includes an indel, e.g., a frameshift mutation, e.g., as described herein, at or near the target sequence of a targeting domain of a gRNA molecule to said component of the TCR. In embodiments, the population of cells includes at least about 50%, e.g., at least about 60%, e.g., at least about 70%, e.g., at least about 80%, e.g., at least about 90% or more cells (as described herein) which exhibit reduced or eliminated expression of a component of the TCR. In embodiments, said reduced or eliminated expression of a component of the TCR is as measured by flow cytometry, e.g., as described herein.

In aspects, (including either alternatively, or in addition to, the reduced or eliminated expression of a component of the TCR) the cell (e.g., population of cells) includes one or more cells that have reduced or eliminated expression of beta-2 microglobulin (B2M). In embodiments, said reduced or eliminated expression of said B2M is the result of introduction of one or more, e.g., one or two, e.g., one gRNA molecule described herein to B2M into said cell. In embodiments, the cell includes an indel, e.g., a frameshift mutation, e.g., as described herein, at or near the target sequence of a targeting domain of a gRNA molecule to said B2M. In embodiments, the population of cells includes at least about 50%, e.g., at least about 60%, e.g., at least about 70%, e.g., at least about 80%, e.g., at least about 90% or more cells (as described herein) which exhibit reduced or eliminated expression of B2M. In embodiments, said reduced or eliminated expression of B2M is as measured by flow cytometry, e.g., as described herein.

In aspects, (including either alternatively, or in addition to, the reduced or eliminated expression of a component of the TCR and/or B2M) the cell (e.g., population of cells) includes one or more cells that have reduced or eliminated expression of CIITA. In embodiments, said reduced or eliminated expression of said CIITA is the result of introduction of one or more, e.g., one or two, e.g., one gRNA molecule to said CIITA described herein into said cell. In embodiments, the cell includes an indel, e.g., a frameshift mutation, e.g., as described herein, at or near the target sequence of a targeting domain of a gRNA molecule to said CIITA. In embodiments, the population of cells includes at least about 50%, e.g., at least about 60%, e.g., at least about 70%, e.g., at least about 80%, e.g., at least about 90% or more cells (as described herein) which exhibit reduced or eliminated expression of CIITA. In embodiments, said reduced or eliminated expression of B2M is as measured by flow cytometry, e.g., as described herein.

In aspects, (including either alternatively, or in addition to, the reduced or eliminated expression of a component of the TCR) the cell (e.g., population of cells) includes one or more cells that have reduced or eliminated expression of a target of an immunosuppressant, e.g., FKBP1A. In embodiments, said reduced or eliminated expression of said FKBP1A is the result of introduction of one or more, e.g., one or two, e.g., one, gRNA molecule described herein to said FKBP1A into said cell. In embodiments, the cell includes an indel, e.g., a frameshift mutation, e.g., as described herein, at or near the target sequence of a targeting domain of a gRNA molecule to said FKBP1A. In embodiments, the population of cells includes at least about 50%, e.g., at least about 60%, e.g., at least about 70%, e.g., at least about 80%, e.g., at least about 90% or more cells (as described herein) which exhibit reduced or eliminated expression of FKBP1A. In embodiments, said reduced or eliminated expression of FKBP1A is as measured by flow cytometry, e.g., as described herein.

In some aspects, it is desired that the cell exhibits reduced or eliminated expression of more than one gene. In an aspect, the cell exhibits reduced or eliminated expression of a component of the TCR (e.g., TRAC, TRBC1, TRBC2, CD3E, CD3G, and/or CD3D), reduced or eliminated expression of B2M, and reduced or eliminated expression of CIITA. In embodiments, the reduced or eliminated expression results from introduction into the cell a combination of gRNA molecules, wherein the gRNA molecules of the combination include the targeting domain sequences listed in any of combinations A1 to A72. In embodiments, the reduced or eliminated expression results from introduction into the cell a combination of gRNA molecules, wherein the gRNA molecules of the combination include the targeting domain sequences listed in any of combinations B1 to B84. In embodiments, said cell includes an indel, e.g., a frameshift mutation, at or near the target sequences of each of the gRNA molecule targeting domains listed in Table 33, Table 34 or Table 38 (e.g., the gRNA molecules in any of combinations A1 to A72, B1 to B84, or F1 to F60).

In some aspects, it is desired that the cell exhibits reduced or eliminated expression of more than one gene. In an aspect, the cell exhibits reduced or eliminated expression of a component of the TCR (e.g., TRAC, TRBC1, TRBC2, CD3E, CD3G, and/or CD3D), and reduced or eliminated expression of a target of an immunosuppressant, e.g., FKBP1A. In embodiments, the reduced or eliminated expression results from introduction into the cell a combination of gRNA molecules, wherein the gRNA molecules of the combination include the targeting domain sequences listed in any of combinations C1 to C42. In embodiments, the reduced or eliminated expression results from introduction into the cell a combination of gRNA molecules, wherein the gRNA molecules of the combination include the targeting domain sequences listed in any of combinations D1 to D36. In embodiments, said cell includes an indel, e.g., a frameshift mutation, at or near the target sequences of each of the gRNA molecule targeting domains listed in Table 35, Table 36 or Table 37 (e.g., the gRNA molecules in any of combinations C1 to C42, D1 to D36, or E1 to E30).

In preferred embodiments in which it is intended to reduce or eliminate expression of both a component of the T cell receptor, e.g., TRAC, and B2M (including embodiments when expression or function of an additional target, e.g., more than one additional target, e.g., CIITA, is also reduced or eliminated), the gRNA molecule which targets TRAC is selected from SEQ ID NO: 7833, SEQ ID NO: 7834, SEQ ID NO: 7835, a dgRNA comprising, e.g., consisting of, SEQ ID NO: 7836 and SEQ ID NO: 6660, a dgRNA comprising, e.g., consisting of, SEQ ID NO: 7837 and SEQ ID NO: 6660, a dgRNA comprising, e.g., consisting of, SEQ ID NO: 7836 and SEQ ID NO: 10798, and a dgRNA comprising, e.g., consisting of, SEQ ID NO: 7837 and SEQ ID NO: 10798, and the gRNA molecule which targets B2M is selected from SEQ ID NO: 7853, SEQ ID NO: 7854, SEQ ID NO: 7855, a dgRNA comprising, e.g., consisting of, SEQ ID NO: 7856 and SEQ ID NO: 6660, a dgRNA comprising, e.g., consisting of, SEQ ID NO: 7857 and SEQ ID NO: 6660, a dgRNA comprising, e.g., consisting of, SEQ ID NO: 7856 and SEQ ID NO: 10798, and a dgRNA comprising, e.g., consisting of, SEQ ID NO: 7857 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRAC, and B2M (including embodiments when expression or function of an additional target, e.g., more than one additional target, e.g., CIITA, is also reduced or eliminated), the gRNA molecule which targets TRAC is selected from SEQ ID NO: 7833, SEQ ID NO: 7834, SEQ ID NO: 7835, a dgRNA comprising, e.g., consisting of, SEQ ID NO: 7836 and SEQ ID NO: 6660, a dgRNA comprising, e.g., consisting of, SEQ ID NO: 7837 and SEQ ID NO: 6660, a dgRNA comprising, e.g., consisting of, SEQ ID NO: 7836 and SEQ ID NO: 10798, and a dgRNA comprising, e.g., consisting of, SEQ ID NO: 7837 and SEQ ID NO: 10798, and the gRNA molecule which targets B2M is selected from SEQ ID NO: 7858, SEQ ID NO: 7859, SEQ ID NO: 7860, a dgRNA comprising, e.g., consisting of, SEQ ID NO: 7861 and SEQ ID NO: 6660, a dgRNA comprising, e.g., consisting of, SEQ ID NO: 7862 and SEQ ID NO: 6660, a dgRNA comprising, e.g., consisting of, SEQ ID NO: 7861 and SEQ ID NO: 10798, and a dgRNA comprising, e.g., consisting of, SEQ ID NO: 7862 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRAC, and B2M (including embodiments when expression or function of an additional target, e.g., more than one additional target, e.g., CIITA, is also reduced or eliminated), the gRNA molecule which targets TRAC is selected from SEQ ID NO: 7838, SEQ ID NO: 7839, SEQ ID NO: 7840, a dgRNA comprising, e.g., consisting of, SEQ ID NO: 7841 and SEQ ID NO: 6660, a dgRNA comprising, e.g., consisting of, SEQ ID NO: 7842 and SEQ ID NO: 6660, a dgRNA comprising, e.g., consisting of, SEQ ID NO: 7841 and SEQ ID NO: 10798, and a dgRNA comprising, e.g., consisting of, SEQ ID NO: 7842 and SEQ ID NO: 10798, and the gRNA molecule which targets B2M is selected from SEQ ID NO: 7853, SEQ ID NO: 7854, SEQ ID NO: 7855, a dgRNA comprising, e.g., consisting of, SEQ ID NO: 7856 and SEQ ID NO: 6660, a dgRNA comprising, e.g., consisting of, SEQ ID NO: 7857 and SEQ ID NO: 6660, a dgRNA comprising, e.g., consisting of, SEQ ID NO: 7856 and SEQ ID NO: 10798, and a dgRNA comprising, e.g., consisting of, SEQ ID NO: 7857 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRAC, and B2M (including embodiments when expression or function of an additional target, e.g., more than one additional target, e.g., CIITA, is also reduced or eliminated), the gRNA molecule which targets TRAC is selected from SEQ ID NO: 7838, SEQ ID NO: 7839, SEQ ID NO: 7840, a dgRNA comprising, e.g., consisting of, SEQ ID NO: 7841 and SEQ ID NO: 6660, a dgRNA comprising, e.g., consisting of, SEQ ID NO: 7842 and SEQ ID NO: 6660, a dgRNA comprising, e.g., consisting of, SEQ ID NO: 7841 and SEQ ID NO: 10798, and a dgRNA comprising, e.g., consisting of, SEQ ID NO: 7842 and SEQ ID NO: 10798, and the gRNA molecule which targets B2M is selected from SEQ ID NO: 7858, SEQ ID NO: 7859, SEQ ID NO: 7860, a dgRNA comprising, e.g., consisting of, SEQ ID NO: 7861 and SEQ ID NO: 6660, a dgRNA comprising, e.g., consisting of, SEQ ID NO: 7862 and SEQ ID NO: 6660, a dgRNA comprising, e.g., consisting of, SEQ ID NO: 7861 and SEQ ID NO: 10798, and a dgRNA comprising, e.g., consisting of, SEQ ID NO: 7862 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRBC, and B2M (including embodiments when expression or function of an additional target, e.g., more than one additional target, e.g., CIITA, is also reduced or eliminated), the gRNA molecule which targets TRBC is selected from SEQ ID NO: 7843, SEQ ID NO: 7844, SEQ ID NO: 7845, a dgRNA comprising, e.g., consisting of, SEQ ID NO: 7846 and SEQ ID NO: 6660, a dgRNA comprising, e.g., consisting of, SEQ ID NO: 7847 and SEQ ID NO: 6660, a dgRNA comprising, e.g., consisting of, SEQ ID NO: 7846 and SEQ ID NO: 10798, and a dgRNA comprising, e.g., consisting of, SEQ ID NO: 7847 and SEQ ID NO: 10798, and the gRNA molecule which targets B2M is selected from SEQ ID NO: 7853, SEQ ID NO: 7854, SEQ ID NO: 7855, a dgRNA comprising, e.g., consisting of, SEQ ID NO: 7856 and SEQ ID NO: 6660, a dgRNA comprising, e.g., consisting of, SEQ ID NO: 7857 and SEQ ID NO: 6660, a dgRNA comprising, e.g., consisting of, SEQ ID NO: 7856 and SEQ ID NO: 10798, and a dgRNA comprising, e.g., consisting of, SEQ ID NO: 7857 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRBC, and B2M (including embodiments when expression or function of an additional target, e.g., more than one additional target, e.g., CIITA, is also reduced or eliminated), the gRNA molecule which targets TRBC is selected from SEQ ID NO: 7843, SEQ ID NO: 7844, SEQ ID NO: 7845, a dgRNA comprising, e.g., consisting of, SEQ ID NO: 7846 and SEQ ID NO: 6660, a dgRNA comprising, e.g., consisting of, SEQ ID NO: 7847 and SEQ ID NO: 6660, a dgRNA comprising, e.g., consisting of, SEQ ID NO: 7846 and SEQ ID NO: 10798, and a dgRNA comprising, e.g., consisting of, SEQ ID NO: 7847 and SEQ ID NO: 10798, and the gRNA molecule which targets B2M is selected from SEQ ID NO: 7858, SEQ ID NO: 7859, SEQ ID NO: 7860, a dgRNA comprising, e.g., consisting of, SEQ ID NO: 7861 and SEQ ID NO: 6660, a dgRNA comprising, e.g., consisting of, SEQ ID NO: 7862 and SEQ ID NO: 6660, a dgRNA comprising, e.g., consisting of, SEQ ID NO: 7861 and SEQ ID NO: 10798, and a dgRNA comprising, e.g., consisting of, SEQ ID NO: 7862 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRBC, and B2M (including embodiments when expression or function of an additional target, e.g., more than one additional target, e.g., CIITA, is also reduced or eliminated), the gRNA molecule which targets TRBC is selected from SEQ ID NO: 7848, SEQ ID NO: 7849, SEQ ID NO: 7850, a dgRNA comprising, e.g., consisting of, SEQ ID NO: 7851 and SEQ ID NO: 6660, a dgRNA comprising, e.g., consisting of, SEQ ID NO: 7852 and SEQ ID NO: 6660, a dgRNA comprising, e.g., consisting of, SEQ ID NO: 7851 and SEQ ID NO: 10798, and a dgRNA comprising, e.g., consisting of, SEQ ID NO: 7852 and SEQ ID NO: 10798, and the gRNA molecule which targets B2M is selected from SEQ ID NO: 7853, SEQ ID NO: 7854, SEQ ID NO: 7855, a dgRNA comprising, e.g., consisting of, SEQ ID NO: 7856 and SEQ ID NO: 6660, a dgRNA comprising, e.g., consisting of, SEQ ID NO: 7857 and SEQ ID NO: 6660, a dgRNA comprising, e.g., consisting of, SEQ ID NO: 7856 and SEQ ID NO: 10798, and a dgRNA comprising, e.g., consisting of, SEQ ID NO: 7857 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRBC, and B2M (including embodiments when expression or function of an additional target, e.g., more than one additional target, e.g., CIITA, is also reduced or eliminated), the gRNA molecule which targets TRBC is selected from SEQ ID NO: 7848, SEQ ID NO: 7849, SEQ ID NO: 7850, a dgRNA comprising, e.g., consisting of, SEQ ID NO: 7851 and SEQ ID NO: 6660, a dgRNA comprising, e.g., consisting of, SEQ ID NO: 7852 and SEQ ID NO: 6660, a dgRNA comprising, e.g., consisting of, SEQ ID NO: 7851 and SEQ ID NO: 10798, and a dgRNA comprising, e.g., consisting of, SEQ ID NO: 7852 and SEQ ID NO: 10798, and the gRNA molecule which targets B2M is selected from SEQ ID NO: 7858, SEQ ID NO: 7859, SEQ ID NO: 7860, a dgRNA comprising, e.g., consisting of, SEQ ID NO: 7861 and SEQ ID NO: 6660, a dgRNA comprising, e.g., consisting of, SEQ ID NO: 7862 and SEQ ID NO: 6660, a dgRNA comprising, e.g., consisting of, SEQ ID NO: 7861 and SEQ ID NO: 10798, and a dgRNA comprising, e.g., consisting of, SEQ ID NO: 7862 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRAC, and FKBP1A (including embodiments when expression or function of an additional target, e.g., more than one additional target, is also reduced or eliminated), the gRNA molecule which targets TRAC is selected from SEQ ID NO: 7833, SEQ ID NO: 7834, SEQ ID NO: 7835, a dgRNA comprising, e.g., consisting of, SEQ ID NO: 7836 and SEQ ID NO: 6660, a dgRNA comprising, e.g., consisting of, SEQ ID NO: 7837 and SEQ ID NO: 6660, a dgRNA comprising, e.g., consisting of, SEQ ID NO: 7836 and SEQ ID NO: 10798, and a dgRNA comprising, e.g., consisting of, SEQ ID NO: 7837 and SEQ ID NO: 10798, and the gRNA molecule which targets FKBP1A is selected from SEQ ID NO: 7863, SEQ ID NO: 7864, SEQ ID NO: 7865, a dgRNA comprising, e.g., consisting of, SEQ ID NO: 7866 and SEQ ID NO: 6660, a dgRNA comprising, e.g., consisting of, SEQ ID NO: 7867 and SEQ ID NO: 6660, a dgRNA comprising, e.g., consisting of, SEQ ID NO: 7866 and SEQ ID NO: 10798, and a dgRNA comprising, e.g., consisting of, SEQ ID NO: 7867 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRAC, and FKBP1A (including embodiments when expression or function of an additional target, e.g., more than one additional target, is also reduced or eliminated), the gRNA molecule which targets TRAC is selected from SEQ ID NO: 7833, SEQ ID NO: 7834, SEQ ID NO: 7835, a dgRNA comprising, e.g., consisting of, SEQ ID NO: 7836 and SEQ ID NO: 6660, a dgRNA comprising, e.g., consisting of, SEQ ID NO: 7837 and SEQ ID NO: 6660, a dgRNA comprising, e.g., consisting of, SEQ ID NO: 7836 and SEQ ID NO: 10798, and a dgRNA comprising, e.g., consisting of, SEQ ID NO: 7837 and SEQ ID NO: 10798, and the gRNA molecule which targets FKBP1A is selected from SEQ ID NO: 7868, SEQ ID NO: 7869, SEQ ID NO: 7870, a dgRNA comprising, e.g., consisting of, SEQ ID NO: 7871 and SEQ ID NO: 6660, a dgRNA comprising, e.g., consisting of, SEQ ID NO: 7872 and SEQ ID NO: 6660, a dgRNA comprising, e.g., consisting of, SEQ ID NO: 7871 and SEQ ID NO: 10798, and a dgRNA comprising, e.g., consisting of, SEQ ID NO: 7872 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRAC, and FKBP1A (including embodiments when expression or function of an additional target, e.g., more than one additional target, is also reduced or eliminated), the gRNA molecule which targets TRAC is selected from SEQ ID NO: 7838, SEQ ID NO: 7839, SEQ ID NO: 7840, a dgRNA comprising, e.g., consisting of, SEQ ID NO: 7841 and SEQ ID NO: 6660, a dgRNA comprising, e.g., consisting of, SEQ ID NO: 7842 and SEQ ID NO: 6660, a dgRNA comprising, e.g., consisting of, SEQ ID NO: 7841 and SEQ ID NO: 10798, and a dgRNA comprising, e.g., consisting of, SEQ ID NO: 7842 and SEQ ID NO: 10798, and the gRNA molecule which targets FKBP1A is selected from SEQ ID NO: 7863, SEQ ID NO: 7864, SEQ ID NO: 7865, a dgRNA comprising, e.g., consisting of, SEQ ID NO: 7866 and SEQ ID NO: 6660, a dgRNA comprising, e.g., consisting of, SEQ ID NO: 7867 and SEQ ID NO: 6660, a dgRNA comprising, e.g., consisting of, SEQ ID NO: 7866 and SEQ ID NO: 10798, and a dgRNA comprising, e.g., consisting of, SEQ ID NO: 7867 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRAC, and FKBP1A (including embodiments when expression or function of an additional target, e.g., more than one additional target, is also reduced or eliminated), the gRNA molecule which targets TRAC is selected from SEQ ID NO: 7838, SEQ ID NO: 7839, SEQ ID NO: 7840, a dgRNA comprising, e.g., consisting of, SEQ ID NO: 7841 and SEQ ID NO: 6660, a dgRNA comprising, e.g., consisting of, SEQ ID NO: 7842 and SEQ ID NO: 6660, a dgRNA comprising, e.g., consisting of, SEQ ID NO: 7841 and SEQ ID NO: 10798, and a dgRNA comprising, e.g., consisting of, SEQ ID NO: 7842 and SEQ ID NO: 10798, and the gRNA molecule which targets FKBP1A is selected from SEQ ID NO: 7868, SEQ ID NO: 7869, SEQ ID NO: 7870, a dgRNA comprising, e.g., consisting of, SEQ ID NO: 7871 and SEQ ID NO: 6660, a dgRNA comprising, e.g., consisting of, SEQ ID NO: 7872 and SEQ ID NO: 6660, a dgRNA comprising, e.g., consisting of, SEQ ID NO: 7871 and SEQ ID NO: 10798, and a dgRNA comprising, e.g., consisting of, SEQ ID NO: 7872 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRBC, and FKBP1A (including embodiments when expression or function of an additional target, e.g., more than one additional target, is also reduced or eliminated), the gRNA molecule which targets TRBC is selected from SEQ ID NO: 7843, SEQ ID NO: 7844, SEQ ID NO: 7845, a dgRNA comprising, e.g., consisting of, SEQ ID NO: 7846 and SEQ ID NO: 6660, a dgRNA comprising, e.g., consisting of, SEQ ID NO: 7847 and SEQ ID NO: 6660, a dgRNA comprising, e.g., consisting of, SEQ ID NO: 7846 and SEQ ID NO: 10798, and a dgRNA comprising, e.g., consisting of, SEQ ID NO: 7847 and SEQ ID NO: 10798, and the gRNA molecule which targets FKBP1A is selected from SEQ ID NO: 7863, SEQ ID NO: 7864, SEQ ID NO: 7865, a dgRNA comprising, e.g., consisting of, SEQ ID NO: 7866 and SEQ ID NO: 6660, a dgRNA comprising, e.g., consisting of, SEQ ID NO: 7867 and SEQ ID NO: 6660, a dgRNA comprising, e.g., consisting of, SEQ ID NO: 7866 and SEQ ID NO: 10798, and a dgRNA comprising, e.g., consisting of, SEQ ID NO: 7867 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRBC, and FKBP1A (including embodiments when expression or function of an additional target, e.g., more than one additional target, is also reduced or eliminated), the gRNA molecule which targets TRBC is selected from SEQ ID NO: 7843, SEQ ID NO: 7844, SEQ ID NO: 7845, a dgRNA comprising, e.g., consisting of, SEQ ID NO: 7846 and SEQ ID NO: 6660, a dgRNA comprising, e.g., consisting of, SEQ ID NO: 7847 and SEQ ID NO: 6660, a dgRNA comprising, e.g., consisting of, SEQ ID NO: 7846 and SEQ ID NO: 10798, and a dgRNA comprising, e.g., consisting of, SEQ ID NO: 7847 and SEQ ID NO: 10798, and the gRNA molecule which targets FKBP1A is selected from SEQ ID NO: 7868, SEQ ID NO: 7869, SEQ ID NO: 7870, a dgRNA comprising, e.g., consisting of, SEQ ID NO: 7871 and SEQ ID NO: 6660, a dgRNA comprising, e.g., consisting of, SEQ ID NO: 7872 and SEQ ID NO: 6660, a dgRNA comprising, e.g., consisting of, SEQ ID NO: 7871 and SEQ ID NO: 10798, and a dgRNA comprising, e.g., consisting of, SEQ ID NO: 7872 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRBC, and FKBP1A (including embodiments when expression or function of an additional target, e.g., more than one additional target, is also reduced or eliminated), the gRNA molecule which targets TRBC is selected from SEQ ID NO: 7848, SEQ ID NO: 7849, SEQ ID NO: 7850, a dgRNA comprising, e.g., consisting of, SEQ ID NO: 7851 and SEQ ID NO: 6660, a dgRNA comprising, e.g., consisting of, SEQ ID NO: 7852 and SEQ ID NO: 6660, a dgRNA comprising, e.g., consisting of, SEQ ID NO: 7851 and SEQ ID NO: 10798, and a dgRNA comprising, e.g., consisting of, SEQ ID NO: 7852 and SEQ ID NO: 10798, and the gRNA molecule which targets FKBP1A is selected from SEQ ID NO: 7863, SEQ ID NO: 7864, SEQ ID NO: 7865, a dgRNA comprising, e.g., consisting of, SEQ ID NO: 7866 and SEQ ID NO: 6660, a dgRNA comprising, e.g., consisting of, SEQ ID NO: 7867 and SEQ ID NO: 6660, a dgRNA comprising, e.g., consisting of, SEQ ID NO: 7866 and SEQ ID NO: 10798, and a dgRNA comprising, e.g., consisting of, SEQ ID NO: 7867 and SEQ ID NO: 10798. As described herein, in embodiments of any of the combinations, each of said gRNA molecules is provided as an RNP with a Cas9 molecule, e.g., a Cas9 molecule described herein.

In preferred embodiments in which it is intended to reduce or eliminate expression of both a component of the T cell receptor, e.g., TRBC, and FKBP1A (including embodiments when expression or function of an additional target, e.g., more than one additional target, is also reduced or eliminated), the gRNA molecule which targets TRBC is selected from SEQ ID NO: 7848, SEQ ID NO: 7849, SEQ ID NO: 7850, a dgRNA comprising, e.g., consisting of, SEQ ID NO: 7851 and SEQ ID NO: 6660, a dgRNA comprising, e.g., consisting of, SEQ ID NO: 7852 and SEQ ID NO: 6660, a dgRNA comprising, e.g., consisting of, SEQ ID NO: 7851 and SEQ ID NO: 10798, and a dgRNA comprising, e.g., consisting of, SEQ ID NO: 7852 and SEQ ID NO: 10798, and the gRNA molecule which targets FKBP1A is selected from SEQ ID NO: 7868, SEQ ID NO: 7869, SEQ ID NO: 7870, a dgRNA comprising, e.g., consisting of, SEQ ID NO: 7871 and SEQ ID NO: 6660, a dgRNA comprising, e.g., consisting of, SEQ ID NO: 7872 and SEQ ID NO: 6660, a dgRNA comprising, e.g., consisting of, SEQ ID NO: 7871 and SEQ ID NO: 10798, and a dgRNA comprising, e.g., consisting of, SEQ ID NO: 7872 and SEQ ID NO: 10798. As described herein, in embodiments of any of the combinations, each of said gRNA molecules is provided as an RNP with a Cas9 molecule, e.g., a Cas9 molecule described herein.

In one aspect, the cell exhibits reduced or eliminated expression of only one component of the TCR (though it may exhibit reduced or eliminated expression of one or more other targets which are not a component of the TCR). In embodiments, the cell comprises an indel at or near a target sequence within only a single gene (or its regulatory elements) that is a component of the TCR (though the cell may comprise an indel at or near a target sequence within one or more additional genes (or its regulatory elements) which are not a component of the TCR). Thus, in embodiments, the cell does not comprise an indel within more than one gene that is a component of a TCR. In embodiments, the cell does not comprise an indel within TRAC and within a gene encoding a second component of the TCR, e.g., TRBC1 or TRBC2.

In one aspect, the cell does not exhibit reduced or eliminated expression of a gene comprising a target sequence of an inhibitory molecule or downstream effector of signaling through an inhibitory molecule (though it may exhibit reduced or eliminated expression of one or more other genes). In embodiments, the cell does not include an indel at or near a target sequence in a gene (or its regulatory elements) of an inhibitory molecule or downstream effector of signaling through an inhibitory molecule (though it may include an indel at one or more other genes (or its regulatory elements)). In embodiments, the cell does not comprise an indel within PDCD1 or its regulatory elements.

In aspects, the cell is an animal cell, for example, a mammalian, primate, or human cell, e.g., a human cell. In aspects, the cell is an immune effector cell (e.g., a population of cells including one or more immune effector cells), for example, a T cell or NK cell, for example a T cell, for example a CD4+ T cell, a CD8+ T cell, or a combination thereof.

In aspects, the cell the cell is autologous with respect to a patient to be administered said cell. In other aspects, the cell is allogeneic with respect to a patient to be administered said cell. In embodiments, the cell is allogeneic with respect to a patient to be administered said cell, and is an induced pluripotent stem cell or is a cell derived therefrom. In embodiments, the cell is allogeneic with respect to a patient to be administered said cell, and is an immune effector cell, e.g., a T cell, isolated from a healthy human donor.

In aspects, a cell (or population of cells), e.g., as described herein, e.g., a CAR-expressing cell as described herein, is modified and/or altered, e.g., by the methods described herein, ex vivo. In other aspects, a cell (or population of cells), e.g., as described herein, e.g., a CAR-expressing cell as described herein, is modified and/or altered, e.g., by the methods described herein, in vivo. In aspects, the CRISPR systems, gRNA molecules (including in an RNP complex with a Cas9 molecule as described herein) and/or compositions (e.g., compositions comprising more than one gRNA molecule of the invention) of the invention are introduced into a cell, e.g., as described herein, e.g., a CAR-expressing cell as described herein, ex vivo. In other aspects, the CRISPR systems, gRNA molecules (including in an RNP complex with a Cas9 molecule as described herein) and/or compositions (e.g., compositions comprising more than one gRNA molecule of the invention) of the invention are introduced into a cell, e.g., as described herein, e.g., a CAR-expressing cell as described herein, in vivo.

In aspects, the cell has been, is, or will be, engineered to express a chimeric antigen receptor (CAR), as described herein (for example, the cell includes, or will include, nucleic acid sequence encoding a CAR). In embodiments, the CAR recognizes an antigen selected from: CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRvIII); ganglioside G2 (GD2); ganglioside GD3 (aNeu5Ac(2-8) aNeu5Ac(2-3)bDGalp(1-4)bDGlcp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDGalp(1-4) bDGlcp(1-1)Cer); transglutaminase 5 (TGS5); high molecular weight-melanoma-associated antigen (HMW-MAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), e.g., as described herein.

In embodiments, the CAR includes an antigen recognition domain that binds CD19, e.g., as described herein. In embodiments, the CAR includes an anti-CD19 binding domain that includes, e.g., consists of, SEQ ID NO: 7895. In embodiments, the CAR includes an anti-CD19 binding domain that includes, e.g., consists of, SEQ ID NO: 7884.

In embodiments, the CAR includes an antigen recognition domain that binds BCMA, e.g., as described herein. In embodiments, the CAR includes an anti-BCMA binding domain that includes, e.g., consists of, SEQ ID NO: 7949.

In embodiments, the CAR includes an antigen binding domain, a transmembrane domain, and an intracellular signaling domain. In embodiments the transmembrane domain includes the sequence of SEQ ID NO: 6644. In embodiments, the intracellular signaling domain includes a primary signaling domain and/or a costimulatory signaling domain. In embodiments, the primary signaling domain includes, e.g., consists of, the sequence of SEQ ID NO: 6648 or SEQ ID NO: 6650. In embodiments, the costimulatory signaling domain includes, e.g., consists of, the sequence of SEQ ID NO: 6646 or SEQ ID NO: 6636, e.g., includes, e.g., consists of, the sequence of SEQ ID NO: 6646. In other embodiments, the costimulatory signaling domain includes sequence from the intracellular signaling domain of CD28.

In embodiments, the CAR is a CD19 CAR, and includes, e.g., consists of, the sequence of SEQ ID NO: 7920. In embodiments, the CAR is a CD19 CAR, and includes, e.g., consists of, the sequence of SEQ ID NO: 7909. In embodiments, the cell, e.g., described herein, includes nucleic acid sequence encoding a CD19 CAR described herein, e.g., a CD19 CAR that includes the sequence of SEQ ID NO: 7920 or SEQ ID NO: 7909.

In embodiments, the CAR is a BCMA CAR, and includes, e.g., consists of, the sequence of SEQ ID NO: 8559. In embodiments, the cell, e.g., described herein, includes nucleic acid sequence encoding a BCMA CAR described herein, e.g., a BCMA CAR that includes SEQ ID NO: 8559. In embodiments, the nucleic acid sequence encoding the BCMA CAR includes, e.g., consists of, SEQ ID NO: 8574.

In aspects, the cell of the invention (e.g., the population of the cells of the invention), e.g., described herein, further include nucleic acid sequence encoding an NK inhibitory molecule. Such cells are preferred when the cells exhibit reduced or eliminated expression of one or more major histocompatibility class I (MHC I) molecules (e.g., via reduced or eliminated expression of B2M, e.g., achieved by the methods described herein) and/or reduced or eliminated expression of one or more major histocompatibility class II (MMC II) molecules (e.g., via reduced or eliminated expression of CIITA, e.g., achieved by the methods described herein). In embodiments, the NK inhibitory molecule is an HLA-G molecule, e.g., an HLA-G molecule that does not require B2M, e.g., HLA-G2, HLA-G3, HLA-G4. In other embodiments, the NK inhibitory molecule is an HLA-G:B2M fusion molecule. An exemplary HLA-G:B2M fusion molecule is SEQ ID NO: 10674. An exemplary nucleic acid sequence encoding said HLA-G:B2M fusion is SEQ ID NO: 10675.

In embodiments, the cell (e.g., population of cells), exhibits reduced or eliminated expression of a target of an NK inhibitory molecule, e.g., reduced or eliminated expression of LILRB1.

In embodiments, a CAR-expressing cell of the invention (e.g., the cell wherein expression or function of one or more proteins has been reduced or eliminated, e.g., by the methods described herein), maintains the ability to proliferate in response to stimulation, for example, binding of the CAR to its target antigen. In embodiments, the proliferation occurs ex vivo. In embodiments, the proliferation occurs in vivo. In embodiments, the proliferation occurs both ex vivo and in vivo. In embodiments, the level of proliferation is substantially the same as the level of proliferation exhibited by the same cell type (e.g., a CAR-expressing cell of the same type) but which has not had expression or function of one or more proteins reduced or eliminated, e.g., by the methods described herein. In embodiments, the level of proliferation is at least 80%, at least 85%, at least 90%, at least 95%, at least 98% or more of the level of proliferation exhibited by the same cell type (e.g., a CAR-expressing cell of the same type) but which has not had expression or function of one or more proteins reduced or eliminated, e.g., by the methods described herein.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting. Headings, sub-headings or numbered or lettered elements, e.g., (a), (b), (i) etc, are presented merely for ease of reading. The use of headings or numbered or lettered elements in this document does not require the steps or elements be performed in alphabetical order or that the steps or elements are necessarily discrete from one another. Other features, objects, and advantages of the invention will be apparent from the description and drawings, and from the claims.

BRIEF DESCRIPTION OF THE DRAWINGS

FIG. 6: Expression profiles of primary T cells engineered to express a CD19 CAR and treated with RNP comprising gRNA targeting TCR alpha. Pre-enrichment shows the cell populations that are CAR+/− and TCR+/− following 11 days in culture. Post-enrichment shows >98% TCR− T cells after isolation using a CD3 microbead negative selection step.

FIG. 7: Shown is the cytotoxic activity of CD19 CAR transduced T-cells against a target positive (Nalm6-luc) and target negative (K562-luc) cell line. "T1" and "T8" refer to gRNA TRAC-1 and TRAC-8 respectively. Shown are lentivirus or RNP-introduced Cas9/gRNA, and the results for both unsorted and TCR− sorted ("sorted") T cell populations

FIG. 12: Mean (n≥3) editing of CRISPR systems with dgRNAs as indicated to TRAC in HEK cells (stably expressing Cas9) or primary human CD3+ T cells (delivery of dgRNA:Cas9 RNP by electroporation). Also shown is % of cells exhibiting loss of TCR as determined by flow cytometry using an anti-TCRa/b antibody.

FIG. 14: Mean (n≥3) editing of CRISPR systems with dgRNAs as indicated to B2M in HEK cells (stably expressing Cas9), in CD34+ primary human hematopoietic stem cells, and % loss of B2M in primary CD3+ T cells as measured by flow cytometry. NGS assays were run 24 hours after introduction of the CRISPR systems to the indicated cells; Flow cytometry assay was run 3-5 days after introduction of the CRISPR systems to the CD3+ T cells.

FIG. 17B: % of cells negative for both B2M and TCR at the indicated gRNA ratios.

FIG. 23: % editing (N=3) and % Frameshift edit (FS) as measured by NGS in HEK293 cells stably expressing Cas9 using dgRNAs that include the targeting domain to FKBP1A as indicated.

FIG. 24: % editing (N=3) and % Frameshift edit (FS edit) as measured by NGS in CD3+ T cells using RNPs that include dgRNAs that include the targeting domain to FKBP1A indicated.

FIG. 33C: Genomic editing of the TRAC locus resulting from human primary T cell electroporation with RNP containing the indicated gRNA targeting the TRAC locus is shown. The frequency of insertions or deletions is indicated (% indels) and the percentage of these edits that result in frameshifting of the coding sequence is shown (% frameshift edits).

FIGS. 34A and 34B: The top 5 most frequently observed sequence changes are shown in detail for each TRAC targeting gRNA used for primary human T cell editing. FIGS. 34A and 34B are the outcome from 2 independently performed electroporation experiments. Wild type (wt) unmodified bases are shown in uppercase letters. Deletions relative to wt sequence are shown by "–"; insertions relative to wt sequence are shown by lowercase letters. Data for each experiment are the average from triplicate PCR products. FIG. 34A to 34B disclose SEQ ID NOS 10845-10899, respectively, in order of appearance.

FIG. 36: Genomic editing of the B2M locus resulting from human primary T cell electroporation with RNP containing the indicated gRNA targeting the B2M locus. The frequency of insertions or deletions is indicated (% indels) and the percentage of these edits that result in frameshifting of the coding sequence is shown (% frameshift edits) in the top panel. The top 10 most frequently observed sequence changes are shown in the bottom panel in detail for each B2M targeting gRNA used for primary human T cell editing. Wild type (wt) unmodified bases are shown in uppercase letters. Deletions relative to wt sequence are shown by "–"; insertions relative to wt sequence are shown by lowercase letters. Data are the average from triplicate PCR products. FIG. 36 discloses SEQ ID NOS 10900-10919, respectively, in order of appearance.

FIG. 38: Genomic editing of the CIITA locus resulting from human primary T cell electroporation with RNP containing the indicated gRNA targeting the CIITA locus is shown. The frequency of insertions or deletions is indicated (% indels) and the percentage of these edits that result in frameshifting of the coding sequence is shown (% frameshift edits). The top 5 most frequently observed sequence changes are shown in detail in the bottom panel. Wild type (wt) unmodified bases are shown in uppercase letters. Deletions relative to wt sequence are shown by "–"; insertions relative to wt sequence are shown by lowercase letters. Data are the average from triplicate PCR products. FIG. 38 discloses SEQ ID NOS 10920-10939, respectively, in order of appearance.

FIG. 40: Genomic editing of the CIITA locus resulting from human primary T cell electroporation with RNP containing the indicated gRNA targeting the CIITA locus is shown. The frequency of insertions or deletions is indicated (% indels) and the percentage of these edits that result in frameshifting of the coding sequence is shown (% frameshift edits).

FIG. 41: The top 5 most frequently observed sequence changes (indels) for each CIITA targeting gRNA used for primary human T cell editing. Data are the average from triplicate PCR products. Wild type (wt) unmodified bases are shown in uppercase letters. Deletions relative to wt sequence are shown by "–"; insertions relative to wt sequence are shown by lowercase letters. FIG. 41 discloses SEQ ID NOS 10940-10974, respectively, in order of appearance.

FIG. 43: Genomic editing of the CIITA locus resulting from human primary T cell electroporation with RNP containing the indicated gRNA targeting the CIITA locus is shown. The frequency of insertions or deletions is indicated (% indels) and the percentage of these edits that result in frameshifting of the coding sequence is shown (% frameshift edits).

FIG. 44. The top 5 most frequently observed sequence changes for each CIITA targeting gRNA used for primary human T cell editing. Data are the average from triplicate PCR products. Wild type (wt) unmodified bases are shown in uppercase letters. Deletions relative to wt sequence are shown by "–"; insertions relative to wt sequence are shown by lowercase letters. FIG. 44 discloses SEQ ID NOS 10975-11014, respectively, in order of appearance.

FIG. 47: Genomic editing of the B2M, TRAC, and CIITA loci resulting from human primary T cell simultaneous electroporation with 3 RNPs containing gRNAs targeting the B2M, TRAC, and CIITA loci. The frequency of insertions or deletions is indicated (% indels) and the percentage of these edits that result in frameshifting of the coding sequence is shown in parentheses.

FIG. 48: The top 10 most frequently observed sequence changes at the B2M locus in primary human T cells for the B2M targeting gRNA CR00442 in the context of simultaneous editing of 3 loci (triple editing) with different concentrations of each RNP as shown in the schematic in FIG. 45. Wild type (wt) unmodified bases are shown in uppercase letters. Deletions relative to wt sequence are shown by "–"; insertions relative to wt sequence are shown by lowercase letters. Data are the average from triplicate PCR products. FIG. 48 discloses SEQ ID NOS 11015-11054, respectively, in order of appearance.

FIG. 49: The top 10 most frequently observed sequence changes at the TRAC locus in primary human T cells for the TRAC targeting gRNA CR000961 in the context of simultaneous editing of 3 loci (triple editing) with different concentrations of each RNP as shown in the schematic in FIG. 45. Wild type (wt) unmodified bases are shown in uppercase letters. Deletions relative to wt sequence are shown by "–"; insertions relative to wt sequence are shown by lowercase letters. Data are the average from triplicate PCR products. FIG. 49 discloses SEQ ID NOS 11055-11094, respectively, in order of appearance.

FIG. 50: The top 10 most frequently observed sequence changes at the CIITA locus in primary human T cells for the CIITA targeting gRNA CR002991 in the context of simultaneous editing of 3 loci (triple editing) with different concentrations of each RNP as shown in the schematic in FIG. 45. Wild type (wt) unmodified bases are shown in uppercase letters. Deletions relative to wt sequence are shown by "–"; insertions relative to wt sequence are shown by lowercase letters. Data are the average from triplicate PCR products. FIG. 50 discloses SEQ ID NOS 11095-11134, respectively, in order of appearance.

FIG. 52: Genomic editing of the FKBP1A locus resulting from human primary T cell electroporation with RNPs containing the indicated gRNAs targeting FKBP1A. The frequency of insertions or deletions is indicated (% indels) and the percentage of these edits that result in frameshifting of the coding sequence is shown.

FIG. 53: The top 5 most frequently observed sequence changes for each FKBP1A targeting gRNA used for primary human T cell editing are shown. Wild type (wt) unmodified bases are shown in uppercase letters. Deletions relative to wt sequence are shown by "–"; insertions relative to wt sequence are shown by lowercase letters. Data are the average from triplicate PCR products. FIG. 53 discloses SEQ ID NOS 11135-11159, respectively, in order of appearance.

FIG. 58: Sensitivity to gene edited (TRAC and/or FKBP1A) CART cells to RAD001. CART cells were prepared expressing the BCMA10 CAR (FIG. 58A-1, FIG. 58A-2, and FIG. 58A-3), the CD19 CAR (FIG. 58B-1. FIG. 58B-2, and FIG. 58B-3), or no CAR (FIG. 59C-1, FIG. 58C-2, and FIG. 58C-3; UTD). Gene editing was performed on CART cells or UTD cells using the CR000961 guide to target the TRAC locus and/or the CR002097 and CR002086 guides to target the FKBP1A locus (as indicated by 961, 2097, and 2086, respectively). CART cells electroporated with an RNP containing no guide RNA were prepared as a negative control. After RNP electroporation cells were treated with 2.5 nM RAD001 (upper panel, indicated at +RAD001) or left untreated (lower panel, indicated as— RAD001) and the impact on mTOR pathway inhibition was evaluated by analyzing S6 phosphorylation (pS6) by flow cytometry. The Y-axis indicates side scatter (SSC) and the X-axis indicates the level of phosphorylated S6 protein (pS6). Positive staining for pS6, shown in the lower right quadrant of the FACS plots, was determined by gating above the fluorescence level seen in a control stained with isotype antibody (not shown). The percentage of cells with phosphorylation of S6 is shown with histograms (upper panels) and graphically (lower panel).

FIG. 65: % editing in primary human CD3+ T cells as measured by loss of surface expression of CD3 (as measured by flow cytometry) 72 hours after introduction of CRISPR systems targeting CD3 delta (dgRNA comprising the indicated targeting domain). Each % CD3-negative cells is the average of three independent experiments (SD=standard deviation).

FIG. 66: % editing in primary human CD3+ T cells as measured by loss of surface expression of CD3 (as measured by flow cytometry) 72 hours after introduction of CRISPR systems targeting CD3 gamma (dgRNA comprising the indicated targeting domain). Each % CD3-negative cells mean value is the average of three independent experiments (SD=standard deviation).

DEFINITIONS

Figure 1:
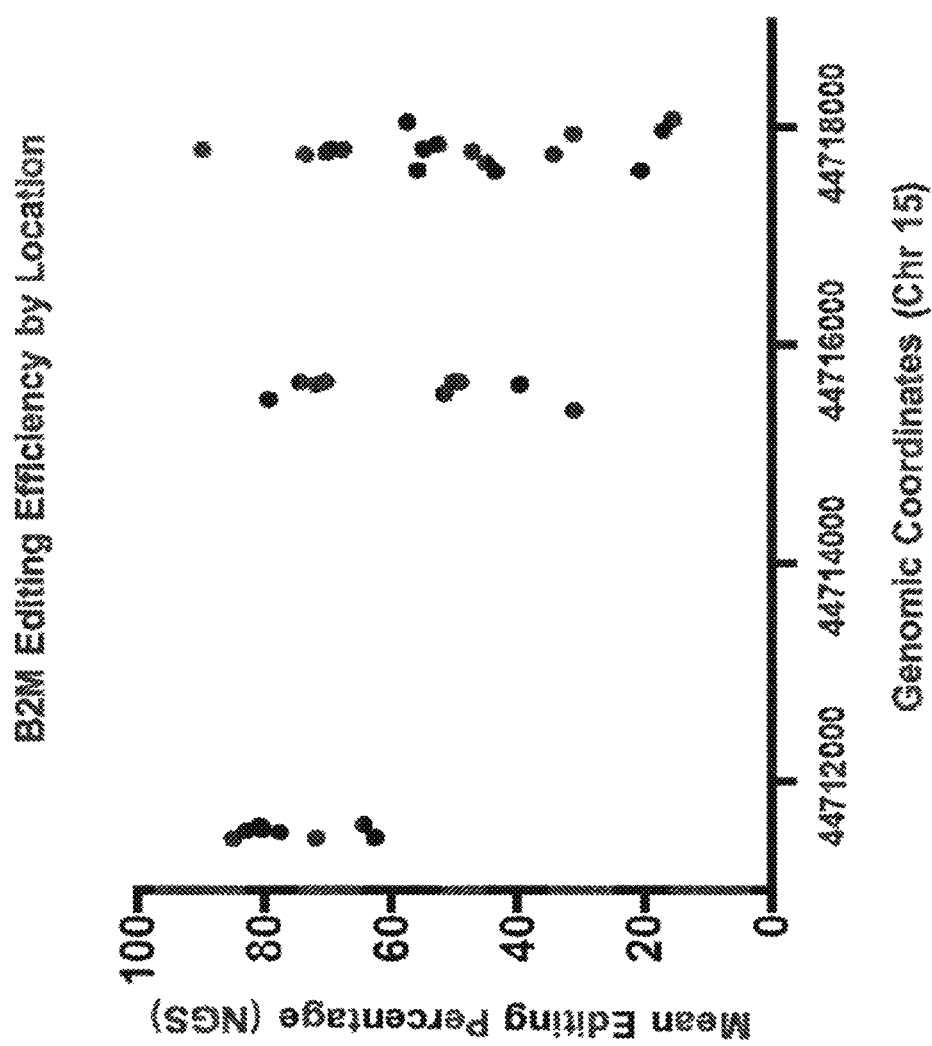
FIG. 1: Cas9 editing of the B2M locus. Fraction of editing detected by NGS in HEK-293 Cas9GFP 24 h post-delivery of crRNA targeting the B2M locus and trRNA by lipofection. Each dot indicates a different crRNA, the trRNA was held constant. Genomic coordinates indicate location on Chromosome 15. (n=3).

The terms "CRISPR system," "Cas system" or "CRISPR/Cas system" refer to a set of molecules comprising an RNA-guided nuclease or other effector molecule and a gRNA molecule that together are necessary and sufficient to direct and effect modification of nucleic acid at a target sequence by the RNA-guided nuclease or other effector molecule. In one embodiment, a CRISPR system comprises a gRNA and a Cas protein, e.g., a Cas9 protein. Such systems comprising a Cas9 or modified Cas9 molecule are referred to herein as "Cas9 systems" or "CRISPR/Cas9 systems." In one example, the gRNA molecule and Cas molecule may be complexed, to form a ribonuclear protein (RNP) complex.

The terms "guide RNA," "guide RNA molecule," "gRNA molecule" or "gRNA" are used interchangeably, and refer to a set of nucleic acid molecules that promote the specific directing of a RNA-guided nuclease or other effector molecule (typically in complex with the gRNA molecule) to a target sequence. In some embodiments, said directing is accomplished through hybridization of a portion of the gRNA to DNA (e.g., through the gRNA targeting domain), and by binding of a portion of the gRNA molecule to the RNA-guided nuclease or other effector molecule (e.g., through at least the gRNA tracr). In embodiments, a gRNA molecule consists of a single contiguous polynucleotide molecule, referred to herein as a "single guide RNA" or "sgRNA" and the like. In other embodiments, a gRNA molecule consists of a plurality, usually two, polynucleotide molecules, which are themselves capable of association, usually through hybridization, referred to herein as a "dual guide RNA" or "dgRNA," and the like. gRNA molecules are described in more detail below, but generally include a targeting domain and a tracr. In embodiments the targeting domain and tracr are disposed on a single polynucleotide. In other embodiments, the targeting domain and tracr are disposed on separate polynucleotides.

The term "targeting domain" as the term is used in connection with a gRNA, is the portion of the gRNA molecule that recognizes, e.g., is complementary to, a target sequence, e.g., a target sequence within the nucleic acid of a cell, e.g., within a gene.

The term "crRNA" as the term is used in connection with a gRNA molecule, is a portion of the gRNA molecule that comprises a targeting domain and a region that interacts with a tracr to form a flagpole region.

The term "target sequence" refers to a sequence of nucleic acids complimentary, for example fully complementary, to a gRNA targeting domain. In embodiments, the target sequence is disposed on genomic DNA. In an embodiment the target sequence is adjacent to (either on the same strand or on the complementary strand of DNA) a protospacer adjacent motif (PAM) sequence recognized by a protein having nuclease or other effector activity, e.g., a PAM sequence recognized by Cas9. In embodiments, the target sequence is a target sequence of an allogeneic T cell target. In embodiments, the target sequence is a target sequence of an inhibitory molecule. In embodiments, the target sequence is a target sequence of a downstream effector of an inhibitory molecule.

The term "flagpole" as used herein in connection with a gRNA molecule, refers to the portion of the gRNA where the crRNA and the tracr bind to, or hybridize to, one another.

The term "tracr" as used herein in connection with a gRNA molecule, refers to the portion of the gRNA that binds to a nuclease or other effector molecule. In embodiments, the tracr comprises nucleic acid sequence that binds specifically to Cas9. In embodiments, the tracr comprises nucleic acid sequence that forms part of the flagpole.

The terms "Cas9" or "Cas9 molecule" refer to an enzyme from bacterial Type II CRISPR/Cas system responsible for DNA cleavage. Cas9 also includes wild-type protein as well as functional and non-functional mutants thereof.

The term "complementary" as used in connection with nucleic acid, refers to the pairing of bases, A with T or U, and G with C. The term complementary refers to nucleic acid molecules that are completely complementary, that is, form A to T or U pairs and G to C pairs across the entire reference sequence, as well as molecules that are at least 80%, 85%, 90%, 95%, 99% complementary.

"Template Nucleic Acid" as used in connection with homology-directed repair or homologous recombination, refers to nucleic acid to be inserted at the site of modification by the CRISPR system donor sequence for gene repair (insertion) at site of cutting. In one aspect, the template nucleic acid comprises nucleic acid sequence encoding a chimeric antigen receptor (CAR), e.g., as described herein. In one aspect, the template nucleic acid comprises a vector comprising nucleic acid sequence encoding a chimeric antigen receptor (CAR), e.g., as described herein.

An "indel," as the term is used herein, refers to a nucleic acid comprising one or more insertions of nucleotides, one or more deletions of nucleotides, or a combination of insertions and defections of nucleotides, relative to a reference nucleic acid, that results after being exposed to a composition comprising a gRNA molecule, for example a CRISPR system. Indels can be determined by sequencing nucleic acid after being exposed to a composition comprising a gRNA molecule, for example, by NGS. With respect to the site of an indel, an indel is said to be "at or near" a reference site (e.g., a site complementary to a targeting domain of a gRNA molecule) if it comprises at least one insertion or deletion within about 10, 9, 8, 7, 6, 5, 4, 3, 2, or 1 nucleotide(s) of the reference site, or is overlapping with part or all of said reference site (e.g., comprises at least one insertion or deletion overlapping with, or within 10, 9, 8, 7, 6, 5, 4, 3, 2, or 1 nucleotides of a site complementary to the targeting domain of a gRNA molecule, e.g., a gRNA molecule described herein).

An "indel pattern," as the term is used herein, refers to a set of indels that results after exposure to a composition comprising a gRNA molecule. In an embodiment, the indel pattern consists of the top three indels, by frequency of appearance. In an embodiment, the indel pattern consists of the top five indels, by frequency of appearance. In an embodiment, the indel pattern consists of the indels which are present at greater than about 5% frequency relative to all sequencing reads. In an embodiment, the indel pattern consists of the indels which are present at greater than about 10% frequency relative to total number of indel sequencing reads (i.e., those reads that do not consist of the unmodified reference nucleic acid sequence). In an embodiment, the indel pattern includes of any 3 of the top five most frequently observed indels. The indel pattern may be determined, for example, by sequencing cells of a population of cells which were exposed to the gRNA molecule.

An "off-target indel," as the term I used herein, refers to an indel at or near a site other than the target sequence of the targeting domain of the gRNA molecule. Such sites may comprise, for example, 1, 2, 3, 4, 5 or more mismatch nucleotides relative to the sequence of the targeting domain of the gRNA. In exemplary embodiments, such sites are detected using targeted sequencing of in silico predicted off-target sites, or by an insertional method known in the art.

The term "inhibitory molecule" refers to a molecule, which when activated, causes or contributes to an inhibition of cell survival, activation, proliferation and/or function; and the gene encoding said molecule and its associated regulatory elements, e.g., promoters. In embodiments, an inhibitory molecule is a molecule expressed on an immune effector cell, e.g., on a T cell. Non-limiting examples of inhibitory molecules are PD-1, PD-L1, PD-L2, CTLA4, TIM3, LAG3, CEACAM (e.g., CEACAM-1, CEACAM-3 and/or CEACAM-5), VISTA, BTLA, TIGIT, LAIR1, CD160, 2B4, CD80, CD86, B7-H3 (CD276), B7-H4 (VTCN1), HVEM (TNFRSF14 or CD107), KIR, A2aR, MHC class I, MHC class II, GAL9, adenosine, and TGF beta. It will be understood that the term inhibitory molecule refers to the gene (and its associated regulatory elements) encoding an inhibitory molecule protein when it is used in connection with a target sequence or gRNA molecule. In an embodiment, gene encoding the inhibitory molecule is CD274. In an embodiment, the gene encoding the inhibitory molecule is HAVCR2. In an embodiment, the gene encoding the inhibitory molecule is LAG3. In an embodiment, the gene encoding the inhibitory molecule is PDCD1.

The term "downstream effector of signaling through an inhibitory molecule" refers to a molecule that mediates the inhibitory effect of an inhibitory molecule; and the gene encoding said molecule and its associated regulatory elements, e.g., promoters. It will be understood that the term downstream effector of signaling through an inhibitory molecule refers to the gene (and its associated regulatory elements) encoding a downstream effector of signaling through an inhibitory molecule protein when it is used in connection with a target sequence or gRNA molecule. In an embodiment, the gene encoding the downstream effector of signaling through an inhibitory molecule is PTPN11.

The terms "allogeneic T cell target" and "allogeneic T-cell target" are used interchangeably herein, and refer to a protein that mediates or contributes to a host versus graft response, mediates or contributes to a graft versus host response, or is a target for an immunosuppressant; and the gene encoding said molecule and its associated regulatory elements, e.g., promoters. It will be understood that the term allogeneic T cell target refers to the gene (and its associated regulatory elements) encoding an allogeneic T cell target protein when it is used in connection with a target sequence or gRNA molecule. Without being bound by theory, inhibition or elimination of one or more allogeneic cell targets, e.g., by the methods and compositions disclosed herein, may improve the efficacy, survival, function and/or viability of an allogeneic cell, e.g., an allogeneic T cell, for example, by reducing or eliminating undesirable immunogenicity (such as a host versus graft response or a graft versus host response).

In a non-limiting example, the protein that mediates or contributes to a graft versus host response or host versus graft response is one or more components of the T cell receptor. In an embodiment, the component of the T cell receptor is the T cell receptor alpha, for example the constant domain of the TCR alpha. In an embodiment, the component of the T cell receptor is the T cell receptor beta chain, for example the constant domain 1 or constant domain 2 of the TCR beta. In an embodiment, the component of the T cell receptor is the T cell receptor delta chain. In an embodiment, the component of the T cell receptor is the T cell receptor epsilon chain. In an embodiment, the component of the T cell receptor is the T cell receptor zeta chain. In an embodiment, the component of the T cell receptor is the T cell receptor gamma chain. Thus, in embodiments where the protein encoded by the allogeneic T cell target is a component of the TCR, the gene encoding the allogeneic T cell target may be, for example, TRAC, TRBC1, TRBC2, CD3D, CD3E, CD3G or CD247, and combinations thereof.

In a non-limiting example, the protein that mediates or contributes to a graft versus host response or host versus graft response is an HLA protein or B2M. Examples of HLA proteins include HLA-A, HLA-B and HLA-C. Thus, in embodiments where the allogeneic T cell target protein is a HLA or B2M protein, the gene encoding the allogeneic T cell target may be, for example, HLA-A, HLA-B, HLA-C or B2M, and combinations thereof. In other embodiments, the allogeneic T cell target protein is NLRC5, and the gene encoding the allogeneic T cell target may be, for example, NLRC5.

In a non-limiting example, the protein that mediates or contributes to a graft versus host response or host versus graft response is a major histocompatibility complex class II (MHC II) molecule (e.g., HLA-Dx (where x refers to a letter of a MHC II protein, e.g., HLA-DM, HLA-DO, HLA-DR, HLA-DQ and/or HLA-DP)), or a regulatory factor for expression of a MHC II, and combinations thereof. A non-limiting example is CIITA (also referred to herein as C2TA). Thus, in embodiments where the allogeneic T cell target protein is a CIITA, the gene encoding the allogeneic T cell target may be, for example, CIITA. In another non-limiting example, the protein that mediates or contributes to a graft versus host response or host versus graft response is RFXANK. In another non-limiting example, the protein that mediates or contributes to a graft versus host response or host versus graft response is RFXAP. In another non-limiting example, the protein that mediates or contributes to a graft versus host response or host versus graft response is RFX5.

The term "target for an immunosuppressant" as used herein refers to a molecular target, for example a receptor or other protein, for an immunosuppressant agent (the terms, "immunosuppressant" and "immunosuppressive" are used interchangeably herein in connection with an agent, or target for an agent). An immunosuppressant agent is an agent that suppresses immune function by one of several mechanisms of action. In other words, an immunosuppressive agent is a role played by a compound which is exhibited by a capability to diminish the extent and/or voracity of an immune response. One example of a type of activity exhibited by an immunosuppressant agent is the activity of eliminating T-cells, for example, activated T-cells. Another example of a type of activity exhibited by an immunosuppressant agent is the activity of reducing the activity or activation level of T-cells. As a non-limiting example, an immunosuppressive agent can be a calcineurin inhibitor, a target of rapamycin, an interleukin-2 a-chain blocker, an inhibitor of inosine monophosphate dehydrogenase, an inhibitor of dihydrofolic acid reductase, a corticosteroid, cyclosporine, or an immunosuppressive antimetabolite. Classical cytotoxic immunosuppressants act by inhibiting DNA synthesis. Others may act through activation of T-cells or by inhibiting the activation of helper cells. As non limiting examples, targets for immunosuppressive agent can be a receptor for an immunosuppressive agent such as: Deoxycytidine kinase, CD52, glucocorticoid receptor (GR), a FKBP family gene member, e.g., FKBP12, and a cyclophilin family gene member. In an embodiment, the target for an immunosuppressant is deoxycytidine kinase (DCK), and the immunosuppressant is a nucleoside analog-based drug such as cytarabine (cytosine arabinoside) or gemcitabine. In an embodiment, the target for an immunosuppressant is GR, and the immunosuppressant is a corticosteroid such as dexamethasone. In an embodiment, the target for an immunosuppressant is CD52, and the immunosuppressant is an anti-CD52 antibody or antigen-binding fragment thereof such as alemtuzumab (CAMPATH®). In an embodiment, the target for an immunosuppressant is FKBP12, and the immunosuppressant is FK506 (or analog or FKBP12-binding fragment thereof), cyclosporine, rapamycin or rapalog, or mTor inhibitor such as RAD001. Thus, in embodiments where the allogeneic T cell target is a target for an immunosuppressant protein, the gene encoding the allogeneic T cell target may be, for example, NR3C1, FKBP1A, CD52, or DCK, and combinations thereof.

The term "rapamycin-resistant mTor" refers to an mTor protein (and the gene encoding said mTor protein) which has reduced or eliminated binding to FKBP12 (including in the presence of rapamycin, FK506, a rapalog, cyclosporin and/or other mTor inhibitor such as RAD001). In exemplary embodiments, the rapamycin-resistant mTor comprises one or more mutations to the FRB domain. In an exemplary embodiment, the rapamycin resistant mTor comprises, e.g., consists of, a mutation to S2035, e.g., comprises, e.g., consists of, an S2035I mutation.

The term "a" and "an" refers to one or to more than one (i.e., to at least one) of the grammatical object of the article. By way of example, "an element" means one element or more than one element.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods.

The term "Chimeric Antigen Receptor" or alternatively a "CAR" refers to a set of polypeptides, typically two in the simplest embodiments, which when in an immune effector cell, provides the cell with specificity for a target cell, typically a cancer cell, and with intracellular signal generation. In some embodiments, a CAR comprises at least an extracellular antigen binding domain, a transmembrane domain and a cytoplasmic signaling domain (also referred to herein as "an intracellular signaling domain") comprising a functional signaling domain derived from a stimulatory molecule and/or costimulatory molecule as defined below. In some aspects, the set of polypeptides are contiguous with each other. In some embodiments, the set of polypeptides include a dimerization switch that, upon the presence of a dimerization molecule, can couple the polypeptides to one another, e.g., can couple an antigen binding domain to an intracellular signaling domain. In one aspect, the stimulatory molecule is the zeta chain associated with the T cell receptor complex. In one aspect, the cytoplasmic signaling domain further comprises one or more functional signaling domains derived from at least one costimulatory molecule as defined below. In one aspect, the costimulatory molecule is chosen from the costimulatory molecules described herein, e.g., 4 1BB (i.e., CD137), CD27 and/or CD28. In one aspect, the CAR comprises a chimeric fusion protein comprising an extracellular antigen binding domain, a transmembrane domain and an intracellular signaling domain comprising a functional signaling domain derived from a stimulatory molecule. In one aspect, the CAR comprises a chimeric fusion protein comprising an extracellular antigen binding domain, a transmembrane domain and an intracellular signaling domain comprising a functional signaling domain derived from a costimulatory molecule and a functional signaling domain derived from a stimulatory molecule. In one aspect, the CAR comprises a chimeric fusion protein comprising an extracellular antigen binding domain, a transmembrane domain and an intracellular signaling domain comprising two functional signaling domains derived from one or more costimulatory molecule(s) and a functional signaling domain derived from a stimulatory molecule. In one aspect, the CAR comprises a chimeric fusion protein comprising an extracellular antigen binding domain, a transmembrane domain and an intracellular signaling domain comprising at least two functional signaling domains derived from one or more costimulatory molecule(s) and a functional signaling domain derived from a stimulatory molecule. In one aspect the CAR comprises an optional leader sequence at the amino-terminus (N-ter) of the CAR fusion protein. In one aspect, the CAR further comprises a leader sequence at the N-terminus of the extracellular antigen binding domain, wherein the leader sequence is optionally cleaved from the antigen binding domain (e.g., a scFv) during cellular processing and localization of the CAR to the cellular membrane.

A CAR that comprises an antigen binding domain (e.g., a scFv, or TCR) that targets a specific tumor marker X, such as those described herein, is also referred to as XCAR. For example, a CAR that comprises an antigen binding domain that targets CD19 is referred to as CD19CAR. As another example, a CAR that comprises an antigen binding domain that targets BCMA is referred to as a BCMA CAR.

The term "signaling domain" refers to the functional portion of a protein which acts by transmitting information within the cell to regulate cellular activity via defined signaling pathways by generating second messengers or functioning as effectors by responding to such messengers.

The term "antibody," as used herein, refers to a protein, or polypeptide sequence derived from an immunoglobulin molecule which specifically binds with an antigen. Antibodies can be polyclonal or monoclonal, multiple or single chain, or intact immunoglobulins, and may be derived from natural sources or from recombinant sources. Antibodies can be tetramers of immunoglobulin molecules.

The term "antibody fragment" refers to at least one portion of an antibody, that retains the ability to specifically interact with (e.g., by binding, steric hinderance, stabilizing/destabilizing, spatial distribution) an epitope of an antigen. Examples of antibody fragments include, but are not limited to, Fab, Fab', F(ab')2, Fv fragments, scFv antibody fragments, disulfide-linked Fvs (sdFv), a Fd fragment consisting of the VH and CH1 domains, linear antibodies, single domain antibodies such as sdAb (either VL or VH), camelid domains, multi-specific antibodies formed from antibody fragments such as a bivalent fragment comprising two Fab fragments linked by a disulfide brudge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3) (see U.S. Pat. No. 6,703,199, which describes fibronectin polypeptide minibodies).

The term "scFv" refers to a fusion protein comprising at least one antibody fragment comprising a variable region of a light chain and at least one antibody fragment comprising a variable region of a heavy chain, wherein the light and heavy chain variable regions are contiguously linked, e.g., via a synthetic linker, e.g., a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the polypeptide, the scFv may comprise VL-linker-VH or may comprise VH-linker-VL.

The portion of the CAR of the invention comprising an antibody or antibody fragment thereof may exist in a variety of forms where the antigen binding domain is expressed as part of a contiguous polypeptide chain including, for example, a single domain antibody fragment (sdAb), a single chain antibody (scFv), a humanized antibody or bispecific antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426). In one aspect, the antigen binding domain of a CAR composition of the invention comprises an antibody fragment. In a further aspect, the CAR comprises an antibody fragment that comprises a scFv. The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, MD ("Kabat" numbering scheme), Al-Lazikani et al., (1997) JMB 273, 927-948 ("Chothia" numbering scheme), or a combination thereof.

As used herein, the term "binding domain" or "antibody molecule" refers to a protein, e.g., an immunoglobulin chain or fragment thereof, comprising at least one immunoglobulin variable domain sequence. The term "binding domain" or "antibody molecule" encompasses antibodies and antibody fragments. In an embodiment, an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope.

The portion of the CAR of the invention comprising an antibody or antibody fragment thereof may exist in a variety of forms where the antigen binding domain is expressed as part of a contiguous polypeptide chain including, for example, a single domain antibody fragment (sdAb), a single chain antibody (scFv), a humanized antibody, or bispecific antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426). In one aspect, the antigen binding domain of a CAR composition of the invention comprises an antibody fragment. In a further aspect, the CAR comprises an antibody fragment that comprises a scFv.

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

The term "recombinant antibody" refers to an antibody which is generated using recombinant DNA technology, such as, for example, an antibody expressed by a bacteriophage or yeast expression system. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using recombinant DNA or amino acid sequence technology which is available and well known in the art.

The term "antigen" or "Ag" refers to a molecule that provokes an immune response. This immune response may involve either antibody production, or the activation of specific immunologically-competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full length nucleotide sequence of a gene. It is readily apparent that the present invention includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated synthesized or can be derived from a biological sample, or might be macromolecule besides a polypeptide. Such a biological sample can include, but is not limited to a tissue sample, a tumor sample, a cell or a fluid with other biological components.

The term "anti-cancer effect" refers to a biological effect which can be manifested by various means, including but not limited to, e.g., a decrease in tumor volume, a decrease in the number of cancer cells, a decrease in the number of metastases, an increase in life expectancy, decrease in cancer cell proliferation, decrease in cancer cell survival, or amelioration of various physiological symptoms associated with the cancerous condition. An "anti-cancer effect" can also be manifested by the ability of the peptides, polynucleotides, cells and antibodies in prevention of the occurrence of cancer in the first place. The term "anti-tumor effect" refers to a biological effect which can be manifested by various means, including but not limited to, e.g., a decrease in tumor volume, a decrease in the number of tumor cells, a decrease in tumor cell proliferation, or a decrease in tumor cell survival.

The term "autologous" refers to any material derived from the same individual into whom it is later to be re-introduced.

The term "allogeneic" refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically The term "xenogeneic" refers to a graft derived from an animal of a different species.

The term "cancer" refers to a disease characterized by the uncontrolled growth of aberrant cells. Cancer cells can spread locally or through the bloodstream and lymphatic system to other parts of the body. Examples of various cancers are described herein and include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer and the like. The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors.

"Derived from" as that term is used herein, indicates a relationship between a first and a second molecule. It generally refers to structural similarity between the first molecule and a second molecule and does not connotate or include a process or source limitation on a first molecule that is derived from a second molecule. For example, in the case of an intracellular signaling domain that is derived from a CD3zeta molecule, the intracellular signaling domain retains sufficient CD3zeta structure such that is has the required function, namely, the ability to generate a signal under the appropriate conditions. It does not connotate or include a limitation to a particular process of producing the intracellular signaling domain, e.g., it does not mean that, to provide the intracellular signaling domain, one must start with a CD3zeta sequence and delete unwanted sequence, or impose mutations, to arrive at the intracellular signaling domain.

The phrase "disease associated with expression of a tumor antigen as described herein" includes, but is not limited to, a disease associated with expression of a tumor antigen as described herein or condition associated with cells which express a tumor antigen as described herein including, e.g., proliferative diseases such as a cancer or malignancy or a precancerous condition such as a myelodysplasia, a myelodysplastic syndrome or a preleukemia; or a noncancer related indication associated with cells which express a tumor antigen as described herein. In one aspect, a cancer associated with expression of a tumor antigen as described herein is a hematological cancer. In one aspect, a cancer associated with expression of a tumor antigen as described herein is a solid cancer. Further diseases associated with expression of a tumor antigen described herein include, but not limited to, e.g., atypical and/or non-classical cancers, malignancies, precancerous conditions or proliferative diseases associated with expression of a tumor antigen as described herein. Non-cancer related indications associated with expression of a tumor antigen as described herein include, but are not limited to, e.g., autoimmune disease, (e.g., lupus), inflammatory disorders (allergy and asthma) and transplantation. In some embodiments, the tumor antigen-expressing cells express, or at any time expressed, mRNA encoding the tumor antigen. In an embodiment, the tumor antigen-expressing cells produce the tumor antigen protein (e.g., wild-type or mutant), and the tumor antigen protein may be present at normal levels or reduced levels. In an embodiment, the tumor antigen-expressing cells produced detectable levels of a tumor antigen protein at one point, and subsequently produced substantially no detectable tumor antigen protein.

The term "conservative sequence modifications" refers to amino acid modifications that do not significantly affect or alter the binding characteristics of the antibody or antibody fragment containing the amino acid sequence. Such conservative modifications include amino acid substitutions, additions and deletions. Modifications can be introduced into an antibody or antibody fragment of the invention by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a CAR of the invention can be replaced with other amino acid residues from the same side chain family and the altered CAR can be tested using the functional assays described herein.

The term "stimulation," refers to a primary response induced by binding of a stimulatory molecule (e.g., a TCR/CD3 complex or CAR) with its cognate ligand (or tumor antigen in the case of a CAR) thereby mediating a signal transduction event, such as, but not limited to, signal transduction via the TCR/CD3 complex or signal transduction via the appropriate NK receptor or signaling domains of the CAR. Stimulation can mediate altered expression of certain molecules.

The term "stimulatory molecule," refers to a molecule expressed by an immune cell (e.g., T cell, NK cell, B cell) that provides the cytoplasmic signaling sequence(s) that regulate activation of the immune cell in a stimulatory way for at least some aspect of the immune cell signaling pathway. In one aspect, the signal is a primary signal that is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing cytoplasmic signaling sequence that is of particular use in the invention includes, but is not limited to, those derived from CD3 zeta, common FcR gamma (FCER1G), Fc gamma RIIa, FcR beta (Fc Epsilon R1b), CD3 gamma, CD3 delta, CD3 epsilon, CD79a, CD79b, DAP10, and DAP12. In a specific CAR of the invention, the intracellular signaling domain in any one or more CARS of the invention comprises an intracellular signaling sequence, e.g., a primary signaling sequence of CD3-zeta. In a specific CAR of the invention, the primary signaling sequence of CD3-zeta is the sequence provided as SEQ ID NO:18, or the equivalent residues from a non-human species, e.g., mouse, rodent, monkey, ape and the like. In a specific CAR of the invention, the primary signaling sequence of CD3-zeta is the sequence as provided in SEQ ID NO:20, or the equivalent residues from a non-human species, e.g., mouse, rodent, monkey, ape and the like.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

An "intracellular signaling domain," as the term is used herein, refers to an intracellular portion of a molecule. The intracellular signaling domain generates a signal that promotes an immune effector function of the CAR containing cell, e.g., a CART cell. Examples of immune effector function, e.g., in a CART cell, include cytolytic activity and helper activity, including the secretion of cytokines.

In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CART, a primary intracellular signaling domain can comprise a cytoplasmic sequence of a T cell receptor, and a costimulatory intracellular signaling domain can comprise cytoplasmic sequence from co-receptor or costimulatory molecule.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, common FcR gamma (FCER1G), Fc gamma RIIa, FcR beta (Fc Epsilon R1b), CD3 gamma, CD3 delta, CD3 epsilon, CD79a, CD79b, DAP10, and DAP12.

The term "zeta" or alternatively "zeta chain", "CD3-zeta" or "TCR–zeta" is defined as the protein provided as GenBan Acc. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain, or functional derivatives thereof, that are sufficient to functionally transmit an initial signal necessary for T cell activation. In one aspect the cytoplasmic domain of zeta comprises residues 52 through 164 of GenBank Acc. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO:18. In one aspect, the "zeta stimulatory domain" or a "CD3-zeta stimulatory domain" is the sequence provided as SEQ ID NO:20.

The term a "costimulatory molecule" refers to a cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that are contribute to an efficient immune response. Costimulatory molecules include, but are not limited to an MHC class I molecule, BTLA and a Toll ligand receptor, as well as OX40, CD27, CD28, CDS, ICAM-1, LFA-1 (CD11a/CD18), ICOS (CD278), and 4-1BB (CD137). Further examples of such costimulatory molecules include CDS, ICAM-1, GITR, BAFFR, HVEM (LIGHTR), SLAMF7, NKp80 (KLRF1), NKp44, NKp30, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

A costimulatory intracellular signaling domain can be the intracellular portion of a costimulatory molecule. A costimulatory molecule can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, ICAM-1, lymphocyte function-associated antigen-1 (LFA-1), CD2, CDS, CD7, CD287, LIGHT, NKG2C, NKG2D, SLAMF7, NKp80, NKp30, NKp44, NKp46, CD160, B7-113, and a ligand that specifically binds with CD83, and the like.

The intracellular signaling domain can comprise the entire intracellular portion, or the entire native intracellular signaling domain, of the molecule from which it is derived, or a functional fragment or derivative thereof.

The term "4-1BB" refers to a member of the TNFR superfamily with an amino acid sequence provided as GenBank Ace. No. AAA62478.2, or the equivalent residues from a non-human species, e.g., mouse, rodent, monkey, ape and the like; and a "4-1BB costimulatory domain" is defined as amino acid residues 214-255 of GenBank Acc. No. AAA62478.2, or the equivalent residues from a non-human species, e.g., mouse, rodent, monkey, ape and the like. In one aspect, the "4-1BB costimulatory domain" is the sequence provided as SEQ ID NO:14 or the equivalent residues from a non-human species, e.g., mouse, rodent, monkey, ape and the like.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NKT) cells, mast cells, and myeloic-derived phagocytes.

"Immune effector function or immune effector response," as that term is used herein, refers to function or response, e.g., of an immune effector cell, that enhances or promotes an immune attack of a target cell. E.g., an immune effector function or response refers a property of a T or NK cell that promotes killing or the inhibition of growth or proliferation, of a target cell. In the case of a T cell, primary stimulation and co-stimulation are examples of immune effector function or response.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or a RNA may also include introns to the extent that the nucleotide sequence encoding the protein may in some version contain an intron(s).

The term "effective amount" or "therapeutically effective amount" are used interchangeably herein, and refer to an amount of a compound, formulation, material, or composition, as described herein effective to achieve a particular biological result.

The term "endogenous" refers to any material from or produced inside an organism, cell, tissue or system.

The term "exogenous" refers to any material introduced from or produced outside an organism, cell, tissue or system.

The term "expression" refers to the transcription and/or translation of a particular nucleotide sequence driven by a promoter.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "homologous" or "identity" refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. For the most part, humanized antibodies and antibody fragments thereof are human immunoglobulins (recipient antibody or antibody fragment) in which residues from a complementary-determining region (CDR) of the recipient are replaced by residues from a CDR of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, a humanized antibody/antibody fragment can comprise residues which are found neither in the recipient antibody nor in the imported CDR or framework sequences. These modifications can further refine and optimize antibody or antibody fragment performance. In general, the humanized antibody or antibody fragment thereof will comprise substantially all of at least one, and typically two, variable domains, in which all or substantially all of the CDR regions correspond to those of a non-human immunoglobulin and all or a significant portion of the FR regions are those of a human immunoglobulin sequence. The humanized antibody or antibody fragment can also comprise at least a portion of an immunoglobulin constant region (Fc), typically that of a human immunoglobulin. For further details, see Jones et al., Nature, 321: 522-525, 1986; Reichmann et al., Nature, 332: 323-329, 1988; Presta, Curr. Op. Struct. Biol., 2: 593-596, 1992.

"Fully human" refers to an immunoglobulin, such as an antibody or antibody fragment, where the whole molecule is of human origin or consists of an amino acid sequence identical to a human form of the antibody or immunoglobulin.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

The term "parenteral" administration of an immunogenic composition includes, e.g., subcutaneous (s.c.), intravenous (i.v.), intramuscular (i.m.), or intrasternal injection, intratumoral, or infusion techniques.

The term "nucleic acid" or "polynucleotide" refers to deoxyribonucleic acids (DNA) or ribonucleic acids (RNA) and polymers thereof in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); and Rossolini et al., Mol. Cell. Probes 8:91-98 (1994)).

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

The term "promoter" refers to a DNA sequence recognized by the synthetic machinery of the cell, or introduced synthetic machinery, required to initiate the specific transcription of a polynucleotide sequence.

The term "promoter/regulatory sequence" refers to a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

The term "constitutive" promoter refers to a nucleotide sequence which, when operably linked with a polynucleotide which encodes or specifies a gene product, causes the gene product to be produced in a cell under most or all physiological conditions of the cell.

The term "inducible" promoter refers to a nucleotide sequence which, when operably linked with a polynucleotide which encodes or specifies a gene product, causes the gene product to be produced in a cell substantially only when an inducer which corresponds to the promoter is present in the cell.

The term "tissue-specific" promoter refers to a nucleotide sequence which, when operably linked with a polynucleotide encodes or specified by a gene, causes the gene product to be produced in a cell substantially only if the cell is a cell of the tissue type corresponding to the promoter.

The terms "cancer associated antigen" or "tumor antigen" interchangeably refers to a molecule (typically a protein, carbohydrate or lipid) that is expressed on the surface of a cancer cell, either entirely or as a fragment (e.g., MHC/peptide), and which is useful for the preferential targeting of a pharmacological agent to the cancer cell. In some embodiments, a tumor antigen is a marker expressed by both normal cells and cancer cells, e.g., a lineage marker, e.g., CD19 on B cells. In some embodiments, a tumor antigen is a cell surface molecule that is overexpressed in a cancer cell in comparison to a normal cell, for instance, 1-fold over expression, 2-fold overexpression, 3-fold overexpression or more in comparison to a normal cell. In some embodiments, a tumor antigen is a cell surface molecule that is inappropriately synthesized in the cancer cell, for instance, a molecule that contains deletions, additions or mutations in comparison to the molecule expressed on a normal cell. In some embodiments, a tumor antigen will be expressed exclusively on the cell surface of a cancer cell, entirely or as a fragment (e.g., MHC/peptide), and not synthesized or expressed on the surface of a normal cell. In some embodiments, the CARs of the present invention includes CARs comprising an antigen binding domain (e.g., antibody or antibody fragment) that binds to a MHC presented peptide. Normally, peptides derived from endogenous proteins fill the pockets of Major histocompatibility complex (MHC) class I molecules, and are recognized by T cell receptors (TCRs) on CD8+ T lymphocytes. The MHC class I complexes are constitutively expressed by all nucleated cells. In cancer, virus-specific and/or tumor-specific peptide/MHC complexes represent a unique class of cell surface targets for immunotherapy. TCR-like antibodies targeting peptides derived from viral or tumor antigens in the context of human leukocyte antigen (HLA)-A1 or HLA-A2 have been described (see, e.g., Sastry et al., J Virol. 2011 85(5):1935-1942; Sergeeva et al., Blood, 2011 117(16):4262-4272; Verma et al., J Immunol 2010 184(4):2156-2165; Willemsen et al., Gene Ther 2001 8(21):1601-1608; Dao et al., Sci Transl Med 2013 5(176):176ra33; Tassev et al., Cancer Gene Ther 2012 19(2):84-100). For example, TCR-like antibody can be identified from screening a library, such as a human say phage displayed library.

The term "tumor-supporting antigen" or "cancer-supporting antigen" interchangeably refer to a molecule (typically a protein, carbohydrate or lipid) that is expressed on the surface of a cell that is, itself, not cancerous, but supports the cancer cells, e.g., by promoting their growth or survival e.g., resistance to immune cells. Exemplary cells of this type include stromal cells and myeloid-derived suppressor cells (MDSCs). The tumor-supporting antigen itself need not play a role in supporting the tumor cells so long as the antigen is present on a cell that supports cancer cells.

The term "flexible polypeptide linker" or "linker" as used in the context of a scFv refers to a peptide linker that consists of amino acids such as glycine and/or serine residues used alone or in combination, to link variable heavy and variable light chain regions together. In one embodiment, the flexible polypeptide linker is a Gly/Ser linker and comprises the amino acid sequence (Gly-Gly-Gly-Ser)n, where n is a positive integer equal to or greater than 1. For example, n=1, n=2, n=3. n=4, n=5 and n=6, n=7, n=8, n=9 and n=10 (SEQ ID NO:6592). In one embodiment, the flexible polypeptide linkers include, but are not limited to, (Gly4 Ser)4 (SEQ ID NO:6593) or (Gly4 Ser)3 (SEQ ID NO:6594). In another embodiment, the linkers include multiple repeats of (Gly2Ser), (GlySer) or (Gly3Ser) (SEQ ID NO:6595). Also included within the scope of the invention are linkers described in WO2012/138475, incorporated herein by reference).

As used herein in connection with a messenger RNA (mRNA), a 5' cap (also termed an RNA cap, an RNA 7-methylguanosine cap or an RNA m7G cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is critical for recognition by the ribosome and protection from RNases. Cap addition is coupled to transcription, and occurs co-transcriptionally, such that each influences the other. Shortly after the start of transcription, the end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

As used herein, "in vitro transcribed RNA" refers to RNA, preferably mRNA, that has been synthesized in vitro. Generally, the in vitro transcribed RNA is generated from an in vitro transcription vector. The in vitro transcription vector comprises a template that is used to generate the in vitro transcribed RNA.

As used herein, a "poly(A)" is a series of adenosines attached by polyadenylation to the mRNA. In the preferred embodiment of a construct for transient expression, the polyA is between 50 and 5000 (SEQ ID NO: 6596), preferably greater than 64, more preferably greater than 100, most preferably greater than 300 or 400. poly(A) sequences can be modified chemically or enzymatically to modulate mRNA functionality such as localization, stability or efficiency of translation.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase.

In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA near the cleavage site. After the mRNA has been cleaved, adenosine residues are added to the free 3' end at the cleavage site.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell.

As used herein, the terms "treat", "treatment" and "treating" refer to the reduction or amelioration of the progression, severity and/or duration of a proliferative disorder, or the amelioration of one or more symptoms (preferably, one or more discernible symptoms) of a proliferative disorder resulting from the administration of one or more therapies (e.g., one or more therapeutic agents such as a CAR of the invention). In specific embodiments, the terms "treat", "treatment" and "treating" refer to the amelioration of at least one measurable physical parameter of a proliferative disorder, such as growth of a tumor, not necessarily discernible by the patient. In other embodiments the terms "treat", "treatment" and "treating"-refer to the inhibition of the progression of a proliferative disorder, either physically by, e.g., stabilization of a discernible symptom, physiologically by, e.g., stabilization of a physical parameter, or both. In other embodiments the terms "treat", "treatment" and "treating" refer to the reduction or stabilization of tumor size or cancerous cell count.

The term "signal transduction pathway" refers to the biochemical relationship between a variety of signal transduction molecules that play a role in the transmission of a signal from one portion of a cell to another portion of a cell. The phrase "cell surface receptor" includes molecules and complexes of molecules capable of receiving a signal and transmitting signal across the membrane of a cell.

The term "subject" is intended to include living organisms in which an immune response can be elicited (e.g., mammals, human).

The term, a "substantially purified" cell refers to a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some aspects, the cells are cultured in vitro. In other aspects, the cells are not cultured in vitro.

The term "therapeutic" as used herein means a treatment. A therapeutic effect is obtained by reduction, suppression, remission, or eradication of a disease state.

The term "prophylaxis" as used herein means the prevention of or protective treatment for a disease or disease state.

In the context of the present invention, "tumor antigen" or "hyperproliferative disorder antigen" or "antigen associated with a hyperproliferative disorder" refers to antigens that are common to specific hyperproliferative disorders. In certain aspects, the hyperproliferative disorder antigens of the present invention are derived from, cancers including but not limited to primary or metastatic melanoma, thymoma, lymphoma, sarcoma, lung cancer, liver cancer, non-Hodgkin lymphoma, Hodgkin lymphoma, leukemias, uterine cancer, cervical cancer, bladder cancer, kidney cancer and adenocarcinomas such as breast cancer, prostate cancer, ovarian cancer, pancreatic cancer, and the like.

The term "transfected" or "transformed" or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

The term "specifically binds," refers to a molecule recognizing and binding with a binding partner (e.g., a protein or nucleic acid) present in a sample, but which molecule does not substantially recognize or bind other molecules in the sample.

"Membrane anchor" or "membrane tethering domain", as that term is used herein, refers to a polypeptide or moiety, e.g., a myristoyl group, sufficient to anchor an extracellular or intracellular domain to the plasma membrane.

The term "bioequivalent" refers to an amount of an agent other than the reference compound (e.g., RAD001), required to produce an effect equivalent to the effect produced by the reference dose or reference amount of the reference compound (e.g., RAD001). In an embodiment the effect is the level of mTOR inhibition, e.g., as measured by P70 S6 kinase inhibition, e.g., as evaluated in an in vivo or in vitro assay, e.g., as measured by an assay described herein, e.g., the Boulay assay. In an embodiment, the effect is alteration of the ratio of PD-1 positive/PD-1 negative T cells, as measured by cell sorting. In an embodiment a bioequivalent amount or dose of an mTOR inhibitor is the amount or dose that achieves the same level of P70 S6 kinase inhibition as does the reference dose or reference amount of a reference compound. In an embodiment, a bioequivalent amount or dose of an mTOR inhibitor is the amount or dose that achieves the same level of alteration in the ratio of PD-1 positive/PD-1 negative T cells as does the reference dose or reference amount of a reference compound.

The term "low, immune enhancing, dose" when used in conjunction with an mTOR inhibitor, e.g., an allosteric mTOR inhibitor, e.g., RAD001 or rapamycin, or a catalytic mTOR inhibitor, refers to a dose of mTOR inhibitor that partially, but not fully, inhibits mTOR activity, e.g., as measured by the inhibition of P70 S6 kinase activity. Methods for evaluating mTOR activity, e.g., by inhibition of P70 S6 kinase, are discussed herein. The dose is insufficient to result in complete immune suppression but is sufficient to enhance the immune response. In an embodiment, the low, immune enhancing, dose of mTOR inhibitor results in a decrease in the number of PD-1 positive T cells and/or an increase in the number of PD-1 negative T cells, or an increase in the ratio of PD-1 negative T cells/PD-1 positive T cells. In an embodiment, the low, immune enhancing, dose of mTOR inhibitor results in an increase in the number of naive T cells. In an embodiment, the low, immune enhancing, dose of mTOR inhibitor results in one or more of the following:

an increase in the expression of one or more of the following markers: CD62Lhigh, CD127high, CD27+, and BCL2, e.g., on memory T cells, e.g., memory T cell precursors;

a decrease in the expression of KLRG1, e.g., on memory T cells, e.g., memory T cell precursors; and an increase in the number of memory T cell precursors, e.g., cells with any one or combination of the following characteristics: increased CD62Lhigh, increased CD127high, increased CD27+, decreased KLRG1, and increased BCL2;

wherein any of the changes described above occurs, e.g., at least transiently, e.g., as compared to a non-treated subject.

"Refractory" as used herein refers to a disease, e.g., cancer, that does not respond to a treatment. In embodiments, a refractory cancer can be resistant to a treatment before or at the beginning of the treatment. In other embodiments, the refractory cancer can become resistant during a treatment. A refractory cancer is also called a resistant cancer.

"Relapsed" as used herein refers to the return of a disease (e.g., cancer) or the signs and symptoms of a disease such as cancer after a period of improvement, e.g., after prior treatment of a therapy, e.g., cancer therapy.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity, includes something with 95%, 96%, 97%, 98% or 99% identity, and includes subranges such as 96-99%, 96-98%, 96-97%, 97-99%, 97-98% and 98-99% identity. This applies regardless of the breadth of the range.

The gRNA molecules, compositions and methods described herein relate to genome editing in eukaryotic cells using a CRISPR/Cas system, e.g., a Cas9 system. In particular, the gRNA molecules, compositions and methods described herein relate to regulation of expression of (or expression of functional versions of) target molecules that have an effect on the function of a transplanted cell, for example a cell for cancer immunotherapy. In an aspect, the transplanted cell is an immune effector cell, e.g., an NK cell or T cell. In an aspect, the cell is an allogeneic cell. In an aspect, the cell has been, is or will be engineered to express a chimeric antigen receptor. Thus, provided herein are compositions and methods for altering, e.g., inhibiting or reducing, the expression and/or function (e.g., the level of expression of a functional version) of a gene product which may improve the efficacy (for example, by reducing or eliminating undesirable immunogenicity (such as a host versus graft response or a graft versus host response)), function, proliferation, stimulation or survival of a transplanted cell, for example a transplanted immune effector cell, for example a NK cell or T cell, for example a T cell engineered to express a chimeric antigen receptor (CAR), for example an allogeneic CAR-expressing T cell for immunotherapy.

In aspects, the gene products are allogeneic T cell targets such as a component of the T cell receptor, e.g., CD3zeta, CD3 epsilon, CD3 gamma, CD3 delta, T cell receptor (TCR) alpha or TCR beta; an FILA molecule or beta-2 micoglobulin (B2M), e.g., an HLA-A, an HLA-B, an HLA-C or B2M; a CIITA molecule; or a target for an immunosuppressant, e.g., glucocorticoid receptor, deoxycytidine kinase, an FKBP, CD52 or a cyclophilin family member; and combinations thereof. Without being bound by theory it is believed that inhibition or elimination of the level of an allogeneic T cell target or level of expression of an allogeneic T cell target gene product (e.g., via alteration of the gene) may improve the function of a cell, e.g., a transplanted cell, e.g., a transplanted immune effector cell, e.g., a CART cell, e.g., an allogeneic CART cell, by reducing or eliminating a graft vs. host response, a host vs. graft response, or will render said transplanted cell resistant to immunosuppressant therapy.

In an aspect, compositions and methods described herein can be used to improve cell, e.g., T cell, e.g., CAR-engineered T cell, e.g., allogeneic CAR-engineered T cell function (for example, by reducing or eliminating undesirable immunogenicity (such as a host versus graft response or a graft versus host response)), survival, proliferation and/or efficacy by altering the gene of a component of the T cell receptor (TCR), e.g., CD3zeta, CD3 epsilon, CD3 gamma, CD3 delta, T cell receptor (TCR) alpha, e.g., constant region of TCR alpha, or TCR beta, e.g., constant region 1 or constant region 2 of TCR beta gene. While not wishing to be bound by theory, it is considered that reduced or absent expression of functional T-cell receptor components reduces or eliminates the presence of TCR on the surface of said cell, thereby reducing or preventing graft vs. host disease by eliminating T cell receptor recognition of and response to host tissues. This approach, therefore, could be used to generate "off the shelf" T cells (Torikai et al., 2012 Blood 119, 5697-5705).

In an aspect, compositions and methods described herein can be used to improve cell, e.g., T cell, e.g., CAR-engineered T cell, e.g., allogeneic CAR-engineered T cell function (for example, by reducing or eliminating undesirable immunogenicity (such as a host versus graft response or a graft versus host response)), survival, proliferation and/or efficacy by altering the gene of a component of the major histocompatibility complex, e.g., an HLA protein or B2M, e.g., HLA-A, HLA-B, HLA-C or B2M (encoded by the B2M gene), or protein which regulates expression of one or more components of the major histocompatibility complex, e.g., NLRC5. While not wishing to be bound by theory, it is considered that reduced or absent expression of a mismatch (e.g., one that does not match the type of the subject receiving the cell therapy) HLA protein (or component) reduces or eliminate host vs. graft disease by eliminating host T cell receptor recognition of and response to mismatched (e.g., allogeneic) graft tissue. This approach, therefore, could be used to generate "off the shelf" T cells.

In an aspect, compositions and methods described herein can be used to improve cell, e.g., T cell, e.g., CAR-engineered T cell, e.g., allogeneic CAR-engineered T cell function (for example, by reducing or eliminating undesirable immunogenicity (such as a host versus graft response or a graft versus host response)), survival, proliferation and/or efficacy by altering a gene of a component of the major histocompatibility complex class II or a regulator of MHC class II expression, e.g., CIITA (encoded by the CIITA gene), RFXANK, RFX5, or RFXAP, and combinations thereof, e.g., CIITA. While not wishing to be bound by theory, it is believed that reducing or eliminating the expression of a regulator of MHC class II expression, e.g., CIITA, will reduce or eliminate the expression of MHC class II molecules on the allogeneic cell, thereby reducing or eliminating expression of a mismatch (e.g., one that does not match the type of the subject receiving the cell therapy) MHC class II protein (or component), thereby reducing or eliminating host vs. graft disease by, e.g., eliminating host T cell receptor recognition of and response to mismatched (e.g., allogeneic) graft tissue, e.g., allogeneic T cell, e.g., allogeneic CART cell, as described herein. This approach, therefore, could be used to generate "off the shelf" T cells.

In an aspect, it may be beneficial to reduce or eliminate expression of both one or more MHC class I molecules and one or more MHC II molecules, e.g., in a T cell, e.g., in an allogeneic T cell, e.g., in an allogeneic CART cell, e.g., as described herein, to further reduce or eliminate the host versus graft disease response upon administration of the cell. Thus, in embodiments of the cells and methods of the invention, cells may be contacted with a composition of the invention (e.g., a composition comprising a gRNA and a Cas9 molecule) comprising a gRNA molecule, e.g., as described herein, to B2M (e.g., such that expression of one or more MHC class I molecules is reduced or eliminated in said cell) and a composition of the invention (e.g., a composition comprising a gRNA and a Cas9 molecule) comprising a gRNA molecule, e.g., as described herein, to CIITA (e.g., such that expression of one or more MHC class II molecules is reduced or eliminated). In embodiments of the cells and methods of the invention, the cell may also be contacted with a composition of the invention (e.g., a composition comprising a gRNA and a Cas9 molecule) comprising a gRNA molecule, e.g., as described herein, to a component of the TCR, e.g., to TRAC and/or TRBC (e.g., such that expression of the T cell receptor, e.g., one or more components of the TCR is reduced or eliminated). In an embodiment, a cell of the invention has reduced or eliminated expression of TCR (e.g., as detected by flow cytometry), reduced or eliminated expression of one or more MHC class I molecules (e.g., as detected by flow cytometry), and reduced or eliminated expression of one or more MHC class II molecules (e.g., as detected by flow cytometry). In an embodiment, a cell of the invention has reduced or eliminated expression of TRAC, reduced or eliminated expression of B2M, and reduced or eliminated expression of CIITA. In an embodiment, a cell of the invention has reduced or eliminated expression of TRAC, reduced or eliminated expression of NLRC5, and reduced or eliminated expression of CIITA. In embodiments, the reduced or eliminated expression is measured relative to a similar cell that has not been treated with a composition or CRISPR system of the invention. In embodiments, the cell is an immune effector cell, e.g., a T cell or NK cell, e.g., a T cell, e.g., as described herein. In embodiments the cell is a T cell which is engineered to express a chimeric antigen receptor (CAR), e.g., as described herein. In embodiments, the CAR is a BCMA CAR, e.g., as described herein. In an embodiment, the invention provides a cell, e.g., an immune effector cell, e.g., a T cell or NK cell, e.g., a T cell, engineered to express a BCMA CAR which is TCR−/B2M−/CIITA− or TCR−/NLRC5−/CIITA−. In embodiments, the cell is a human cell. In embodiments, the cell is allogeneic relative to a subject to be administered said cell. In embodiments, the reduced or eliminated expression of TCR, B2M, NLRC5 and/or CIITA is accomplished by introducing into said cell a composition, CRISPR system, or gRNA of the invention, e.g., as described herein, or by a method as described herein.

In an aspect, compositions and methods described herein can be used to improve cell, e.g., T cell, e.g., CAR-engineered T cell, e.g., allogeneic CAR-engineered T cell function (for example, by reducing or eliminating undesirable immunogenicity (such as a host versus graft response or a graft versus host response)), survival, proliferation and/or efficacy by altering the gene of a target for an immunosuppressant, e.g., glucocorticoid receptor (GR) (encoded by NR3C1). Without being bound by theory, it is considered that absent or reduced expression of functional GR on a cell therapy product allows that cell therapy product to function in the presence of an immunosuppressive such as a corticosteroid such as dexamethasone, said immunosuppressive being administered to, for example, reduce or eliminate host vs. graft disease. This approach, therefore, could be used to generate "off the shelf" T cells.

In an aspect, compositions and methods described herein can be used to improve cell, e.g., T cell, e.g., CAR-engineered T cell, e.g., allogeneic CAR-engineered T cell function (for example, by reducing or eliminating undesirable immunogenicity (such as a host versus graft response or a graft versus host response)), survival, proliferation and/or efficacy by altering the gene of a target for an immunosuppressant, e.g., CD52 (encoded by CD52). Without being bound by theory, it is considered that absent or reduced expression of functional CD52 on a cell therapy product allows that cell therapy product to function in the presence of an immunosuppressive such as an anti-CD52 antibody or antigen-binding fragment thereof such as alemtuzumab (CAMPATH®), said immunosuppressive being administered to, for example, reduce or eliminate host vs. graft disease. This approach, therefore, could be used to generate "off the shelf" T cells.

In an aspect, compositions and methods described herein can be used to improve cell, e.g., T cell, e.g., CAR-engineered T cell, e.g., allogeneic CAR-engineered T cell function (for example, by reducing or eliminating undesirable immunogenicity (such as a host versus graft response or a graft versus host response)), survival, proliferation and/or efficacy by altering the gene of a target for an immunosuppressant, e.g., an FKBP family member, e.g., FKBP12 (encoded by FKBP1A). Without being bound by theory, it is considered that absent or reduced expression of functional FKBP12 on a cell therapy product allows that cell therapy product to function in the presence of an immunosuppressive such as FK506 (or FKBP12-binding fragment or analog thereof), cyclosporine, rapamycin or rapalog, or mTor inhibitor such as RAD001, said immunosuppressive being administered to, for example, reduce or eliminate host vs. graft disease. This approach, therefore, could be used to generate "off the shelf" T cells.

In an aspect, compositions and methods described herein can be used to improve cell, e.g., T cell, e.g., CAR-engineered T cell, e.g., allogeneic CAR-engineered T cell function (for example, by reducing or eliminating undesirable immunogenicity (such as a host versus graft response or a graft versus host response)), survival, proliferation and/or efficacy by altering the gene of a target for an immunosuppressant, e.g., deoxycytidine kinase (encoded by DCK). Without being bound by theory, it is considered that absent or reduced expression of functional deoxycytidine kinase on a cell therapy product allows that cell therapy product to function in the presence of an immunosuppressive a nucleoside analog-based drug such as cytarabine (cytosine arabinoside) or gemcitabine], said immunosuppressive being administered to, for example, reduce or eliminate host vs.

graft disease or treat a cancer. This approach, therefore, could be used to generate "off the shelf" T cells.

In aspects, the gene products are inhibitory molecules, e.g., immune checkpoint proteins, e.g., PD-1, PD-L1, PD-L2, CTLA4, TIM3, LAG3, CEACAM (e.g., CEACAM-1, CEACAM-3 and/or CEACAM-5), VISTA, BTLA, TIGIT, LAIR1, CD160, 2B4, CD80, CD86, B7-H3 (CD276), B7-H4 (VTCN1), HVEM (TNFRSF14 or CD107), KIR, A2aR, MHC class I, MHC class II, GAL9, adenosine, and TGF beta. Without being bound by theory, it is believed that inhibition or elimination of the level of an inhibitory molecule or level of expression of inhibitory molecule gene product (e.g., via alteration of the gene) may improve the function of a cell, e.g., a transplanted cell, e.g., a transplanted immune effector cell, e.g., a CART cell, e.g., an allogeneic CART cell, by reducing or eliminating the inhibitory effects mediated by said inhibitory molecule.

In one aspect, the compositions and methods described herein can be used to decrease the effect of immune suppressive factors on cells, e.g., CAR engineered T cells, by altering the gene of an inhibitory molecule, e.g., PD1. While not wishing to be bound by theory, it is considered that reduced or absent expression of Programed Cell Death 1 (PD-1) (encoded by PDCD1) abrogates the induction of a suppressed or non-responsive state ("anergy").

In one aspect, the compositions and methods described herein can be used to decrease the effect of immune suppressive factors on cells, e.g., CAR engineered T cells, by altering the gene of an inhibitory molecule, e.g., Tim3. While not wishing to be bound by theory, it is considered that reduced or absent expression of Tim3 (encoded by HAVCR2) abrogates the induction of a suppressed or non-responsive state ("anergy").

In one aspect, the compositions and methods described herein can be used to decrease the effect of immune suppressive factors on cells, e.g., CAR engineered T cells, by altering the gene of an inhibitory molecule, e.g., CTLA4 gene. While not wishing to be bound by theory, it is considered that reduced or absent expression of cytotoxic T-lymphocyte associated antigen 4 (encoded by CTLA4) abrogates the induction of a suppressed or non-responsive state ("anergy").

In one aspect, the compositions and methods described herein can be used to decrease the effect of immune suppressive factors on cells, e.g., CAR engineered T cells, by altering the gene of an inhibitory molecule, e.g., Lag3 gene. While not wishing to be bound by theory, it is considered that reduced or absent expression of Lymphocyte-activation gene 3 (Lag3) (encoded by LAG3) abrogates the induction of a suppressed or non-responsive state ("anergy").

In one aspect, the compositions and methods described herein can be used to decrease the effect of immune suppressive factors on cells, e.g., CAR engineered T cells, by altering the gene of an inhibitory molecule, e.g., PD-L1 gene. While not wishing to be bound by theory, it is considered that reduced or absent expression of Programmed Death Ligand 1 (PD-L1, also known as CD274 and B7-H1) (encoded by CD274) abrogates the induction of a suppressed or non-responsive state ("anergy").

In one aspect, the compositions and methods described herein can be used to decrease the effect of immune suppressive factors on cells, e.g., CAR engineered T cells, by altering the gene of a downstream effector molecule of an inhibitory molecule, e.g., Tyrosine-protein phosphatase non-receptor type 1 gene. While not wishing to be bound by theory, it is considered that reduced or absent expression of functional tyrosine-protein phosphatase non-receptor type 1, also known as protein-tyrosine phosphatase 1B, (encoded by PTPN1) abrogates the induction of a suppressed or non-responsive state ("anergy") by affecting signaling through an inhibitory molecule.

In aspects, the compositions and methods described herein may be used in combination to generate cells, e.g., transplanted cells, e.g., allogeneic cells, e.g., immune effector cells, e.g., NK cells or T cells, e.g., CAR-engineered T cells with enhanced efficacy (for example, by reducing or eliminating undesirable immunogenicity (such as a host versus graft response or a graft versus host response)), survival, proliferation and/or stimulation relative to unmodified cells.

In one approach, the compositions and methods described herein may be used to generate cells in which levels or expression levels of a functional component of TCR have been reduced or eliminated and in which levels or expression levels of a functional MHC have been reduced or eliminated. In one embodiment, cells have reduced or eliminated levels or expression levels of TCR alpha and HLA-A. In one embodiment, cells have reduced or eliminated levels or expression levels of TCR alpha and HLA-B. In one embodiment, cells have reduced or eliminated levels or expression levels of TCR alpha and HLA-C. In one embodiment, cells have reduced or eliminated levels or expression levels of TCR alpha and B2M. In one embodiment, cells have reduced or eliminated levels or expression levels of TCR alpha and NLRC5. In one embodiment, cells have reduced or eliminated levels or expression levels of TCR beta and HLA-A. In one embodiment, cells have reduced or eliminated levels or expression levels of TCR beta and HLA-B. In one embodiment, cells have reduced or eliminated levels or expression levels of TCR beta and HLA-C. In one embodiment, cells have reduced or eliminated levels or expression levels of TCR beta and B2M. In one embodiment, cells have reduced or eliminated levels or expression levels of TCR beta and NLRC5. In one embodiment, cells have reduced or eliminated levels or expression levels of CD3zeta and HLA-A. In one embodiment, cells have reduced or eliminated levels or expression levels of CD3zeta and HLA-B. In one embodiment, cells have reduced or eliminated levels or expression levels of CD3zeta and HLA-C. In one embodiment, cells have reduced or eliminated levels or expression levels of CD3zeta and B2M. In one embodiment, cells have reduced or eliminated levels or expression levels of CD3zeta and NLRC5. In one embodiment, cells have reduced or eliminated levels or expression levels of CD3 epsilon and HLA-A. In one embodiment, cells have reduced or eliminated levels or expression levels of CD3 epsilon and HLA-B. In one embodiment, cells have reduced or eliminated levels or expression levels of CD3 epsilon and HLA-C. In one embodiment, cells have reduced or eliminated levels or expression levels of CD3 epsilon and B2M. In one embodiment, cells have reduced or eliminated levels or expression levels of CD3 epsilon and NLRC5. In one embodiment, cells have reduced or eliminated levels or expression levels of CD3 gamma and HLA-A. In one embodiment, cells have reduced or eliminated levels or expression levels of CD3 gamma and HLA-B. In one embodiment, cells have reduced or eliminated levels or expression levels of CD3 gamma and HLA-C. In one embodiment, cells have reduced or eliminated levels or expression levels of CD3 gamma and B2M. In one embodiment, cells have reduced or eliminated levels or expression levels of CD3 gamma and NLRC5. In one embodiment, cells have reduced or eliminated levels or expression levels of CD3 delta and HLA-A. In one embodiment, cells have reduced or eliminated levels or expression levels of CD3 delta and HLA-B. In one embodiment, cells have reduced or eliminated levels or expression levels of CD3 delta and HLA-C. In one embodiment, cells have reduced or eliminated levels or expression levels of CD3 delta and B2M. In one embodiment, cells have reduced or eliminated levels or expression levels of CD3 delta and NLRC5. In any of the aforementioned embodiments, the cells may have reduced or eliminated levels or expression levels of CIITA. In an embodiment, the cells have reduced or eliminated levels or expression levels of TRAC, B2M and CIITA. In an embodiment, the cells have reduced or eliminated levels or expression levels of TRBC, B2M and CIITA. In an embodiment, the cells have reduced or eliminated levels or expression levels of TRAC, TRBC, B2M and CIITA. In an embodiment, the cells have reduced or eliminated levels or expression levels of TRAC, NLRC5 and CIITA. In an embodiment, the cells have reduced or eliminated levels or expression levels of TRBC, NLRC5 and CIITA. In an embodiment, the cells have reduced or eliminated levels or expression levels of TRAC, TRBC, NLRC5 and CIITA. In any of the aforementioned embodiments, the cells may additionally have reduced or eliminated levels or expression levels of one or more inhibitory molecules or downstream effectors of an inhibitory molecule. In one aspect, the one or more inhibitory molecules comprises PD-1. In one aspect, the one or more inhibitory molecules comprises PD-L1. In one aspect, the one or more inhibitory molecules comprises Lag3. In one aspect, the one or more inhibitory molecules comprises Tim3. In one aspect, the one or more inhibitory molecules comprises CTLA4. In one aspect, the one or more inhibitory molecules comprises PTPN1. In one aspect, the one or more inhibitory molecules comprises PD-1 and PD-L1. In one aspect, the one or more inhibitory molecules comprises PD-1 and Lag3. In one aspect, the one or more inhibitory molecules comprises PD-1 and Tim3. In one aspect, the one or more inhibitory molecules comprises PD-1 and CTLA4. In one aspect, the one or more inhibitory molecules comprises PD-L1 and Lag3. In one aspect, the one or more inhibitory molecules comprises PD-L1 and Tim3. In one aspect, the one or more inhibitory molecules comprises PD-L1 and CTLA4. In one aspect, the one or more inhibitory molecules comprises Tim3 and Lag3. In one aspect, the one or more inhibitory molecules comprises Tim3 and CTLA4. In one aspect, the one or more inhibitory molecules comprises Lag3 and CTLA4. In one aspect, the one or more inhibitory molecules comprises, PD-1, PD-L1 and Lag3. In one aspect, the one or more inhibitory molecules comprises, PD-1, PD-L1 and Tim3. In one aspect, the one or more inhibitory molecules comprises, PD-1, PD-L1 and CTLA-4. In one aspect, the one or more inhibitory molecules comprises, PD-1, Tim3 and Lag3. In one aspect, the one or more inhibitory molecules comprises, PD-L1, Tim3 and Lag3. In one aspect, the one or more inhibitory molecules comprises, CTLA4, Tim3 and Lag3.

In one aspect, the compositions and methods described herein may be used to generate cells, e.g., T cells, e.g., CAR-engineered T cells, in which levels or expression levels of two or more, e.g., 2, e.g., 3, e.g., 4, inhibitory molecules have been reduced or eliminated. In one aspect, the two or more, e.g., 2, e.g., 3, e.g., 4, inhibitory molecules comprises PD-1 and PD-L1. In one aspect, the two or more, e.g., 2, e.g., 3, e.g., 4, inhibitory molecules comprises PD-1 and Lag3. In one aspect, the two or more, e.g., 2, e.g., 3, e.g., 4, inhibitory molecules comprises PD-1 and Tim3. In one aspect, the two or more, e.g., 2, e.g., 3, e.g., 4, inhibitory molecules comprises PD-1 and CTLA4. In one aspect, the two or more, e.g., 2, e.g., 3, e.g., 4, inhibitory molecules comprises PD-L1 and Lag3. In one aspect, the two or more, e.g., 2, e.g., 3, e.g., 4, inhibitory molecules comprises PD-L1 and Tim3. In one aspect, the two or more, e.g., 2, e.g., 3, e.g., 4, inhibitory molecules comprises PD-L1 and CTLA4. In one aspect, the two or more, e.g., 2, e.g., 3, e.g., 4, inhibitory molecules comprises Tim3 and Lag3. In one aspect, the two or more, e.g., 2, e.g., 3, e.g., 4, inhibitory molecules comprises Tim3 and CTLA4. In one aspect, the two or more, e.g., 2, e.g., 3, e.g., 4, inhibitory molecules comprises Lag3 and CTLA4. In one aspect, the two or more, e.g., 2, e.g., 3, e.g., 4, inhibitory molecules comprises, PD-1, PD-L1 and Lag3. In one aspect, the two or more, e.g., 2, e.g., 3, e.g., 4, inhibitory molecules comprises, PD-1, PD-L1 and Tim3. In one aspect, the two or more, e.g., 2, e.g., 3, e.g., 4, inhibitory molecules comprises, PD-1, PD-L1 and CTLA-4. In one aspect, the two or more, e.g., 2, e.g., 3, e.g., 4, inhibitory molecules comprises, PD-1, Tim3 and Lag3. In one aspect, the two or more, e.g., 2, e.g., 3, e.g., 4, inhibitory molecules comprises, PD-L1, Tim3 and Lag3. In one aspect, the two or more, e.g., 2, e.g., 3, e.g., 4, inhibitory molecules comprises, CTLA4, Tim3 and Lag3.

In embodiments in which the cells have reduced or eliminated levels or expression levels of TCR alpha, the cells preferably comprise, or at one time comprised, a gRNA molecule comprising a targeting domain comprising SEQ ID NO: SEQ ID NO: 5816 to SEQ ID NO: 5965 or SEQ ID NO: 5528 to SEQ ID NO: 5623, for example, SEQ ID NO: 5569, SEQ ID NO: 5587, SEQ ID NO: 5592 or SEQ ID NO: 5586, or a gRNA molecule comprising a targeting domain consisting of 17, 18, 19, 20, 21, 22, 23, 24 or 25 consecutive nucleotides, preferably 20 consecutive nucleotides, of SEQ ID NO: SEQ ID NO: 5816 to SEQ ID NO: 5965 or SEQ ID NO: 5528 to SEQ ID NO: 5623.

In embodiments in which the cells have reduced or eliminated levels or expression levels of TCR beta, the cells preferably comprise, or at one time comprised, a gRNA molecule comprising a targeting domain comprising SEQ ID NO: 5966 to SEQ ID NO: 6097 or SEQ ID NO: 5624 to SEQ ID NO: 5643, or a gRNA molecule comprising a targeting domain consisting of 17, 18, 19, 20, 21, 22, 23, 24 or 25 consecutive nucleotides, preferably 20 consecutive nucleotides, of SEQ ID NO: 5966 to SEQ ID NO: 6097 or SEQ ID NO: 5624 to SEQ ID NO: 5643. In embodiments in which the cells have reduced or eliminated levels or expression levels of TCR beta, the cells preferably comprise, or at one time comprised, a gRNA molecule comprising a targeting domain comprising SEQ ID NO: 6098 to SEQ ID NO: 6226 or SEQ ID NO: 5644 to SEQ ID NO: 5719, or a gRNA molecule comprising a targeting domain consisting of 17, 18, 19, 20, 21, 22, 23, 24 or 25 consecutive nucleotides, preferably 20 consecutive nucleotides, of SEQ ID NO: 6098 to SEQ ID NO: 6226 or SEQ ID NO: 5644 to SEQ ID NO: 5719.

In embodiments in which the cells have reduced or eliminated levels or expression levels of CD3zeta (encoded by CD247 gene), the cells preferably comprise, or at one time comprised, a gRNA molecule comprising a targeting domain comprising SEQ ID NO: 84 to SEQ ID NO: 392, or a gRNA molecule comprising a targeting domain consisting of 17, 18, 19, 20, 21, 22, 23, 24 or 25 consecutive nucleotides, preferably 20 consecutive nucleotides, of SEQ ID NO: 84 to SEQ ID NO: 392.

In embodiments in which the cells have reduced or eliminated levels or expression levels of CD3 epsilon (encoded by CD3E gene), the cells preferably comprise, or at one time comprised, a gRNA molecule comprising a targeting domain comprising SEQ ID NO: 533 to SEQ ID NO: 839, or a gRNA molecule comprising a targeting domain consisting of 17, 18, 19, 20, 21, 22, 23, 24 or 25 consecutive nucleotides, preferably 20 consecutive nucleotides, of SEQ ID NO: 533 to SEQ ID NO: 839.

In embodiments in which the cells have reduced or eliminated levels or expression levels of CD3 delta (encoded by CD3D gene), the cells preferably comprise, or at one time comprised, a gRNA molecule comprising a targeting domain comprising SEQ ID NO: 393 to SEQ ID NO: 532, or a gRNA molecule comprising a targeting domain consisting of 17, 18, 19, 20, 21, 22, 23, 24 or 25 consecutive nucleotides, preferably 20 consecutive nucleotides, of SEQ ID NO: 393 to SEQ ID NO: 532.

In embodiments in which the cells have reduced or eliminated levels or expression levels of CD3 gamma (encoded by CD3G gene), the cells preferably comprise, or at one time comprised, a gRNA molecule comprising a targeting domain comprising SEQ ID NO: 840 to SEQ ID NO: 968, or a gRNA molecule comprising a targeting domain consisting of 17, 18, 19, 20, 21, 22, 23, 24 or 25 consecutive nucleotides, preferably 20 consecutive nucleotides, of SEQ ID NO: 840 to SEQ ID NO: 968.

In embodiments in which the cells have reduced or eliminated levels or expression levels of B2M (encoded by B2M gene), the cells preferably comprise, or at one time comprised, a gRNA molecule comprising a targeting domain comprising SEQ ID NO: 1 to SEQ ID NO: 83 or SEQ ID NO: 5492 to SEQ ID NO: 5527, or a gRNA molecule comprising a targeting domain consisting of 17, 18, 19, 20, 21, 22, 23, 24 or 25 consecutive nucleotides, preferably 20 consecutive nucleotides, of SEQ ID NO: 1 to SEQ ID NO: 83 or SEQ ID NO: 5492 to SEQ ID NO: 5527.

In embodiments in which the cells have reduced or eliminated levels or expression levels of NLRC5 (encoded by NLRC5 gene), the cells preferably comprise, or at one time comprised, a gRNA molecule comprising a targeting domain comprising SEQ ID NO: 8622 to SEQ ID NO: 10089, or a gRNA molecule comprising a targeting domain consisting of 17, 18, 19, or 20 consecutive nucleotides, preferably 20 consecutive nucleotides, of SEQ ID NO: 8622 to SEQ ID NO: 10089.

In embodiments in which the cells have reduced or eliminated levels or expression levels of HLA-A (encoded by HLA-A gene), the cells preferably comprise, or at one time comprised, a gRNA molecule comprising a targeting domain comprising SEQ ID NO: 969 to SEQ ID NO: 1345, or a gRNA molecule comprising a targeting domain consisting of 17, 18, 19, 20, 21, 22, 23, 24 or 25 consecutive nucleotides, preferably 20 consecutive nucleotides, of SEQ ID NO: 969 to SEQ ID NO: 1345.

In embodiments in which the cells have reduced or eliminated levels or expression levels of HLA-B (encoded by HLA-B gene), the cells preferably comprise, or at one time comprised, a gRNA molecule comprising a targeting domain comprising SEQ ID NO: 1346 to SEQ ID NO: 1698, or a gRNA molecule comprising a targeting domain consisting of 17, 18, 19, 20, 21, 22, 23, 24 or 25 consecutive nucleotides, preferably 20 consecutive nucleotides, of SEQ ID NO: 1346 to SEQ ID NO: 1698.

In embodiments in which the cells have reduced or eliminated levels or expression levels of HLA-C (encoded by HLA-C gene), the cells preferably comprise, or at one time comprised, a gRNA molecule comprising a targeting domain comprising SEQ ID NO: 1699 to SEQ ID NO: 2068, or a gRNA molecule comprising a targeting domain consisting of 17, 18, 19, 20, 21, 22, 23, 24 or 25 consecutive nucleotides, preferably 20 consecutive nucleotides, of SEQ ID NO: 1699 to SEQ ID NO: 2068.

In embodiments in which the cells have reduced or eliminated levels or expression levels of CIITA (encoded by CTIIA gene), the cells preferably comprise, or at one time comprised, a gRNA molecule comprising a targeting domain comprising any one of SEQ ID NO: 6750 to SEQ ID NO: 7716, or a gRNA molecule comprising a targeting domain consisting of 17, 18, 19, 20, 21, 22, 23, 24 or 25 consecutive nucleotides, preferably 20 consecutive nucleotides, of SEQ ID NO: 6750 to SEQ ID NO: 7716. In embodiments, the gRNA molecule comprises a targeting domain comprises any one of SEQ ID NO: 7717 to SEQ ID NO: 7804.

In embodiments in which the cells have reduced or eliminated levels or expression levels of GR (encoded by NR3C1 gene), the cells preferably comprise, or at one time comprised, a gRNA molecule comprising a targeting domain comprising SEQ ID NO: 2069 to SEQ ID NO: 2941, or a gRNA molecule comprising a targeting domain consisting of 17, 18, 19, 20, 21, 22, 23, 24 or 25 consecutive nucleotides, preferably 20 consecutive nucleotides, of SEQ ID NO: 2069 to SEQ ID NO: 2941.

In embodiments in which the cells have reduced or eliminated levels or expression levels of FKBP12 (encoded by FKBP1A gene), the cells preferably comprise, or at one time comprised, a gRNA molecule comprising a targeting domain comprising SEQ ID NO: 6325 to SEQ ID NO: 6583, or a gRNA molecule comprising a targeting domain consisting of 17, 18, 19, 20, 21, 22, 23, 24 or 25 consecutive nucleotides, preferably 20 consecutive nucleotides, of SEQ ID NO: 6325 to SEQ ID NO: 6583.

In embodiments in which the cells have reduced or eliminated levels or expression levels of CD52 (encoded by CD52 gene), the cells preferably comprise, or at one time comprised, a gRNA molecule comprising a targeting domain comprising SEQ ID NO: 6227 to SEQ ID NO: 6324, or a gRNA molecule comprising a targeting domain consisting of 17, 18, 19, 20, 21, 22, 23, 24 or 25 consecutive nucleotides, preferably 20 consecutive nucleotides, of SEQ ID NO: 6227 to SEQ ID NO: 6324.

In embodiments in which the cells have reduced or eliminated levels or expression levels of DCK (encoded by DCK gene), the cells preferably comprise, or at one time comprised, a gRNA molecule comprising a targeting domain comprising SEQ ID NO: 5278 to SEQ ID NO: 5491, or a gRNA molecule comprising a targeting domain consisting of 17, 18, 19, 20, 21, 22, 23, 24 or 25 consecutive nucleotides, preferably 20 consecutive nucleotides, of SEQ ID NO: 5278 to SEQ ID NO: 5491.

In embodiments in which the cells have reduced or eliminated levels or expression levels of PD-L1 (encoded by CD274 gene), the cells preferably comprise, or at one time comprised, a gRNA molecule comprising a targeting domain comprising SEQ ID NO: 2942 to SEQ ID NO: 3270, or a gRNA molecule comprising a targeting domain consisting of 17, 18, 19, 20, 21, 22, 23, 24 or 25 consecutive nucleotides, preferably 20 consecutive nucleotides, of SEQ ID NO: 2942 to SEQ ID NO: 3270.

In embodiments in which the cells have reduced or eliminated levels or expression levels of Tim3 (encoded by HAVCR2 gene), the cells preferably comprise, or at one time comprised, a gRNA molecule comprising a targeting domain comprising SEQ ID NO: 3271 to SEQ ID NO: 3541, or a gRNA molecule comprising a targeting domain consisting of 17, 18, 19, 20, 21, 22, 23, 24 or 25 consecutive nucleotides, preferably 20 consecutive nucleotides, of SEQ ID NO: 3271 to SEQ ID NO: 3541.

In embodiments in which the cells have reduced or eliminated levels or expression levels of Lag3 (encoded by LAG3 gene), the cells preferably comprise, or at one time comprised, a gRNA molecule comprising a targeting domain comprising SEQ ID NO: 3542 to SEQ ID NO: 4032, or a gRNA molecule comprising a targeting domain consisting of 17, 18, 19, 20, 21, 22, 23, 24 or 25 consecutive nucleotides, preferably 20 consecutive nucleotides, of SEQ ID NO: 3542 to SEQ ID NO: 4032.

In embodiments in which the cells have reduced or eliminated levels or expression levels of PD-1 (encoded by PDCD1 gene), the cells preferably comprise, or at one time comprised, a gRNA molecule comprising a targeting domain comprising SEQ ID NO: 4033 to SEQ ID NO: 4589 or SEQ ID NO: 5720 to SEQ ID NO: 5815, or a gRNA molecule comprising a targeting domain consisting of 17, 18, 19, 20, 21, 22, 23, 24 or 25 consecutive nucleotides, preferably 20 consecutive nucleotides, of SEQ ID NO: 4033 to SEQ ID NO: 4589 or SEQ ID NO: 5720 to SEQ ID NO: 5815. In one embodiment, the gRNA molecule comprises a targeting domain comprising SEQ ID NO: 5775, or comprises a targeting domain comprising or consisting of 17, 18, or 19 consecutive nucleotides of SEQ ID NO: 5775.

In embodiments in which the cells have reduced or eliminated levels or expression levels of Tyrosine-protein phosphatase non-receptor type 1 (encoded by PTPN1 gene), the cells preferably comprise, or at one time comprised, a gRNA molecule comprising a targeting domain comprising SEQ ID NO: 4590 to SEQ ID NO: 5277, or a gRNA molecule comprising a targeting domain consisting of 17, 18, 19, 20, 21, 22, 23, 24 or 25 consecutive nucleotides, preferably 20 consecutive nucleotides, of SEQ ID NO: 4590 to SEQ ID NO: 5277.

In any of the aforementioned aspects and embodiments the cell is an autologous cell. In any of the aforementioned aspects and embodiments, the cell is an allogeneic cell. In any of the aforementioned embodiments and aspects, the cell is or will be engineered to express a chimeric antigen receptor (CAR), e.g., as described herein. In any of the aforementioned aspects and embodiments, the cell is a T cell.

Additional features of the gRNA molecule, the CRISPR systems, Cas9 molecules, cells, CAR molecules, and methods of the invention are described in detail below.

I. gRNA Molecules

A gRNA molecule may have a number of domains, as described more fully below, however, a gRNA molecule typically comprises at least a crRNA domain (comprising a targeting domain) and a tracr. The gRNA molecules of the invention, used as a component of a CRISPR system, are useful for modifying (e.g., modifying the sequence) DNA at or near a target site. Such modifications include deletions and or insertions that result in, for example, reduced or eliminated expression of a functional product of the gene comprising the target site. These uses, and additional uses, are described more fully below.

In an embodiment, a unimolecular, or sgRNA comprises, preferably from 5' to 3': a crRNA (which contains a targeting domain complementary to a target sequence and a region that forms part of a flagpole (i.e., a crRNA flagpole region)); a loop; and a tracr (which contains a domain complementary to the crRNA flagpole region, and a domain which additionally binds a nuclease or other effector molecule, e.g., a Cas molecule, e.g., aCas9 molecule), and may take the following format (from 5' to 3'):

[targeting domain]-[crRNA flagpole region]-[optional first flagpole extension]-[loop]-[optional first tracr extension]-[tracr flagpole region]-[tracr nuclease binding domain].

In embodiments, the tracr nuclease binding domain binds to a Cas protein, e.g., a Cas9 protein.

In an embodiment, a bimolecular, or dgRNA comprises two polynucleotides; the first, preferably from 5' to 3': a crRNA (which contains a targeting domain complementary to a target sequence and a region that forms part of a flagpole; and the second, preferably from 5' to 3': a tracr (which contains a domain complementary to the crRNA flagpole region, and a domain which additionally binds a nuclease or other effector molecule, e.g., a Cas molecule, e.g., Cas9 molecule), and may take the following format (from 5' to 3'):

Polynucleotide 1 (crRNA): [targeting domain]-[crRNA flagpole region]-[optional first flagpole extension]-[optional second flagpole extension]

Polynucleotide 2 (tracr): [optional first tracr extension]-[tracr flagpole region]-[tracr nuclease binding domain]

In embodiments, the tracr nuclease binding domain binds to a Cas protein, e.g., a Cas9 protein.

In some aspects, the targeting domain comprises or consists of a targeting domain sequence described herein, e.g., a targeting domain described in Table 1, 2, 3, 4, 5, 6, 6b, or 6c, or a targeting domain comprising or consisting of 17, 18, 19, 20, 21, 22, 23, 24, or 25 (preferably 20) consecutive nucleotides of a targeting domain sequence described in Table 1, 2, 3, 4, 5, 6, 6b, or 6c.

In some aspects, the flagpole, e.g., the crRNA flagpole region, comprises, from 5' to 3': GUUUUAGAGCUA (SEQ ID NO: 6584).

In some aspects, the flagpole, e.g., the crRNA flagpole region, comprises, from 5' to 3': GUUUAAGAGCUA (SEQ ID NO: 6585).

In some aspects the loop comprises, from 5' to 3': GAAA (SEQ ID NO: 6588).

In some aspects the tracr comprises, from 5' to 3': UAGCAAGUUAAAAUAAGGCUAGUCCGUUAU-CAACUUGAAAAAGUGGCACCGAGUCGGUG C (SEQ ID NO: 6589) and is preferably used in a gRNA molecule comprising SEQ ID NO: 6584.

In some aspects the tracr comprises, from 5' to 3': UAGCAAGUUUAAAUAAGGCUAGUCCGUUAU-CAACUUGAAAAAGUGGCACCGAGUCGGUG C (SEQ ID NO: 6590) and is preferably used in a gRNA molecule comprising SEQ ID NO: 6585.

In some aspects, the gRNA may also comprise, at the 3' end, additional U nucleic acids. For example the gRNA may comprise an additional 1, 2, 3, 4, 5, 6, 7, 8, 9, or 10 U nucleic acids at the 3' end (SEQ ID NO: 10806). In an embodiment, the gRNA comprises an additional 4 U nucleic acids at the 3' end. In the case of dgRNA, one or more of the polynucleotides of the dgRNA (e.g., the polynucleotide comprising the targeting domain and the polynucleotide comprising the tracr) may comprise, at the 3' end, additional U nucleic acids. For example, the case of dgRNA, one or more of the polynucleotides of the dgRNA (e.g., the polynucleotide comprising the targeting domain and the polynucleotide comprising the tracr) may comprise an additional 1, 2, 3, 4, 5, 6, 7, 8, 9, or 10 U nucleic acids at the 3' end (SEQ ID NO: 10806). In an embodiment, in the case of dgRNA, one or more of the polynucleotides of the dgRNA (e.g., the polynucleotide comprising the targeting domain and the polynucleotide comprising the tracr) comprises an additional 4 U nucleic acids at the 3' end. In an embodiment of a dgRNA, only the polynucleotide comprising the tracr comprises the additional U nucleic acid(s), e.g., 4 U nucleic acids. In an embodiment of a dgRNA, only the polynucleotide comprising the targeting domain comprises the additional U nucleic acid(s). In an embodiment of a dgRNA, both the polynucleotide comprising the targeting domain and the polynucleotide comprising the tracr comprise the additional U nucleic acids, e.g., 4 U nucleic acids.

In some aspects, the gRNA may also comprise, at the 3' end, additional A nucleic acids. For example the gRNA may comprise an additional 1, 2, 3, 4, 5, 6, 7, 8, 9, or 10 A nucleic acids at the 3' end (SEQ ID NO: 10809). In an embodiment, the gRNA comprises an additional 4 A nucleic acids at the 3' end. In the case of dgRNA, one or more of the polynucleotides of the dgRNA (e.g., the polynucleotide comprising the targeting domain and the polynucleotide comprising the tracr) may comprise, at the 3' end, additional A nucleic acids. For example, the case of dgRNA, one or more of the polynucleotides of the dgRNA (e.g., the polynucleotide comprising the targeting domain and the polynucleotide comprising the tracr) may comprise an additional 1, 2, 3, 4, 5, 6, 7, 8, 9, or 10 A nucleic acids at the 3' end (SEQ ID NO: 10809). In an embodiment, in the case of dgRNA, one or more of the polynucleotides of the dgRNA (e.g., the polynucleotide comprising the targeting domain and the polynucleotide comprising the tracr) comprises an additional 4 A nucleic acids at the 3' end. In an embodiment of a dgRNA, only the polynucleotide comprising the tracr comprises the additional A nucleic acid(s), e.g., 4 A nucleic acids. In an embodiment of a dgRNA, only the polynucleotide comprising the targeting domain comprises the additional A nucleic acid(s). In an embodiment of a dgRNA, both the polynucleotide comprising the targeting domain and the polynucleotide comprising the tracr comprise the additional U nucleic acids, e.g., 4 A nucleic acids.

In embodiments, one or more of the polynucleotides of the gRNA molecule may comprise a cap at the 5' end.

In an embodiment, a unimolecular, or sgRNA comprises, preferably from 5' to 3': a crRNA (which contains a targeting domain complementary to a target sequence; a crRNA flagpole region; first flagpole extension; a loop; a first tracr extension (which contains a domain complementary to at least a portion of the first flagpole extension); and a tracr (which contains a domain complementary to the crRNA flagpole region, and a domain which additionally binds a Cas9 molecule). In some aspects, the targeting domain comprises a targeting domain sequence described herein, e.g., a targeting domain described in Table 1, 2, 3, 4, 5, 6, 6b, or 6c, or a targeting domain comprising or consisting of 17, 18, 19, 20, 21, 22, 23, 24, or 25 (preferably 20) consecutive nucleotides of a targeting domain sequence described in Table 1, 2, 3, 4, 5, 6, 6b, or 6c, for example the 3' 17, 18, 19, 20, 21, 22, 23, 24 or 25 (preferably 20) consecutive nucleotides of a targeting domain sequence described in Table 1, 2, 3, 4, 5, 6, 6b, or 6c.

In aspects comprising a first flagpole extension and/or a first tracr extension, the flagpole, loop and tracr sequences may be as described above. In general any first flagpole extension and first tracr extension may be employed, provided that they are complementary. In embodiments, the first flagpole extension and first tracr extension consist of 3, 4, 5, 6, 7, 8, 9, 10 or more complementary nucleotides.

In some aspects, the first flagpole extension comprises, from 5' to 3': UGCUG (SEQ ID NO: 6586). In some aspects, the first flagpole extension consists of SEQ ID NO: 6586.

In some aspects, the first tracr extension comprises, from 5' to 3': CAGCA (SEQ ID NO: 6591). In some aspects, the first tracr extension consists of SEQ ID NO: 6591.

In an embodiment, a dgRNA comprises two nucleic acid molecules. In some aspects, the dgRNA comprises a first nucleic acid which contains, preferably from 5' to 3': a targeting domain complementary to a target sequence; a crRNA flagpole region; optionally a first flagpole extension; and, optionally, a second flagpole extension; and a second nucleic acid (which may be referred to herein as a tracr), and comprises at least a domain which binds a Cas molecule, e.g., a Cas9 molecule) comprising preferably from 5' to 3': optionally a first tracr extension; and a tracr (which contains a domain complementary to the crRNA flagpole region, and a domain which additionally binds a Cas, e.g., Cas9, molecule). The second nucleic acid may additionally comprise, at the 3' end (e.g., 3' to the tracr) additional U nucleic acids. For example the tracr may comprise an additional 1, 2, 3, 4, 5, 6, 7, 8, 9, or 10 U nucleic acids at the 3' end (e.g., 3' to the tracr) (SEQ ID NO: 10806). The second nucleic acid may additionally or alternately comprise, at the 3' end (e.g., 3' to the tracr) additional A nucleic acids. For example the tracr may comprise an additional 1, 2, 3, 4, 5, 6, 7, 8, 9, or 10 A nucleic acids at the 3' end (e.g., 3' to the tracr) (SEQ ID NO: 10809). In some aspects, the targeting domain comprises a targeting domain sequence described herein, e.g., a targeting domain described in Table 1, 2, 3, 4, 5, 6, 6b, or 6c, or a targeting domain comprising or consisting of 17, 18, 19, 20, 21, 22, 23, 24, or 25 (preferably 20) consecutive nucleotides of a targeting domain sequence described in Table 1, 2, 3, 4, 5, 6, 6b, or 6c.

In aspects involving a dgRNA, the crRNA flagpole region, optional first flagpole extension, optional first tracr extension and tracr sequences may be as described above.

In some aspects, the optional second flagpole extension comprises, from 5' to 3': UUUUG (SEQ ID NO: 6587).

In embodiments, the 3' 1, 2, 3, 4, or 5 nucleotides, the 5' 1, 2, 3, 4, or 5 nucleotides, or both the 3' and 5' 1, 2, 3, 4, or 5 nucleotides of the gRNA molecule (and in the case of a dgRNA molecule, the polynucleotide comprising the targeting domain and/or the polynucleotide comprising the tracr) are modified nucleic acids, as described more fully in section XIII, below.

The domains are discussed briefly below:

1) The Targeting Domain:

Guidance on the selection of targeting domains can be found, e.g., in Fu Y el al. NAT BIOTECHNOL 2014 (doi: 10.1038/nbt.2808) and Sternberg S H el al. NATURE 2014 (doi: 10.1038/nature13011).

The targeting domain comprises a nucleotide sequence that is complementary, e.g., at least 80, 85, 90, 95, or 99% complementary, e.g., fully complementary, to the target sequence on the target nucleic acid. The targeting domain is part of an RNA molecule and will therefore comprise the base uracil (U), while any DNA encoding the gRNA molecule will comprise the base thymine (T). While not wishing to be bound by theory, it is believed that the complementarity of the targeting domain with the target sequence contributes to specificity of the interaction of the gRNA molecule/Cas9 molecule complex with a target nucleic acid. It is understood that in a targeting domain and target sequence pair, the uracil bases in the targeting domain will pair with the adenine bases in the target sequence.

In an embodiment, the targeting domain is 5 to 50, e.g., 10 to 40, e.g., 10 to 30, e.g., 15 to 30, e.g., 15 to 25 nucleotides in length. In an embodiment, the targeting domain is 15, 16, 17, 18, 19, 20, 21, 22, 23, 24 or 25 nucleotides in length. In an embodiment, the targeting domain is 16 nucleotides in length. In an embodiment, the targeting domain is 17 nucleotides in length. In an embodiment, the targeting domain is 18 nucleotides in length. In an embodiment, the targeting domain is 19 nucleotides in length. In an embodiment, the targeting domain is 20 nucleotides in length. In an embodiment, the targeting domain is 21 nucleotides in length. In an embodiment, the targeting domain is 22 nucleotides in length. In an embodiment, the targeting domain is 23 nucleotides in length. In an embodiment, the targeting domain is 24 nucleotides in length. In an embodiment, the targeting domain is 25 nucleotides in length. In embodiments, the aforementioned 16, 17, 18, 19, 20, 21, 22, 23, 24, or 25 nucleotides comprise the 5'-16, 17, 18, 19, 20, 21, 22, 23, 24, or 25 nucleotides from a targeting domain described in Table 1, 2, 3, 4, 5, 6, 6b, or 6c. In embodiments, the aforementioned 16, 17, 18, 19, 20, 21, 22, 23, 24, or 25 nucleotides comprise the 3'-16, 17, 18, 19, 20, 21, 22, 23, 24, or 25 nucleotides from a targeting domain described in Table 1, 2, 3, 4, 5, 6, 6b, or 6c.

Without being bound by theory, it is believed that the 8, 9 or 10 nucleic acids of the targeting domain disposed at the 3' end of the targeting domain is important for targeting the target sequence, and may thus be referred to as the "core" region of the targeting domain. In an embodiment, the core domain is fully complementary with the target sequence.

The strand of the target nucleic acid with which the targeting domain is complementary is referred to herein as the target sequence. In some aspects, the target sequence is disposed on a chromosome, e.g., is a target within a gene. In some aspects the target sequence is disposed within an exon of a gene. In some aspects the target sequence is disposed within an intron of a gene. In some aspects, the target sequence comprises, or is proximal (e.g., within 10, 20, 30, 40, 50, 100, 200, 300, 400, 500, or 1000 nucleic acids) to a binding site of a regulatory element, e.g., a promoter or transcription factor binding site, of a gene of interest. Some or all of the nucleotides of the domain can have a modification, e.g., modification found in Section XIII herein.

2) crRNA Flagpole Region:

The flagpole contains portions from both the crRNA and the tracr. The crRNA flagpole region is complementary with a portion of the tracr, and in an embodiment, has sufficient complementarity to a portion of the tracr to form a duplexed region under at least some physiological conditions, for example, normal physiological conditions. In an embodiment, the crRNA flagpole region is 5 to 30 nucleotides in length. In an embodiment, the crRNA flagpole region is 5 to 25 nucleotides in length. The crRNA flagpole region can share homology with, or be derived from, a naturally occurring portion of the repeat sequence from a bacterial CRISPR array. In an embodiment, it has at least 50% homology with a crRNA flagpole region disclosed herein, e.g., an S. pyogenes, or S. thermophilus, crRNA flagpole region.

In an embodiment, the flagpole, e.g., the crRNA flagpole region, comprises SEQ ID NO: 6584. In an embodiment, the flagpole, e.g., the crRNA flagpole region, comprises sequence having at least 50%, 60%, 70%, 80%, 85%, 90%, 95% or 99% homology with SEQ ID NO: 6584. In an embodiment, the flagpole, e.g., the crRNA flagpole region, comprises at least 5, 6, 7, 8, 9, 10, or 11 nucleotides of SEQ ID NO: 6584. In an embodiment, the flagpole, e.g., the crRNA flagpole region, comprises SEQ ID NO: 6585. In an embodiment, the flagpole comprises sequence having at least 50%, 60%, 70%, 80%, 85%, 90%, 95% or 99% homology with SEQ ID NO: 6585. In an embodiment, the flagpole, e.g., the crRNA flagpole region, comprises at least 5, 6, 7, 8, 9, 10, or 11 nucleotides of SEQ ID NO: 6585.

Some or all of the nucleotides of the domain can have a modification, e.g., modification described in Section XIII herein.

3) First Flagpole Extension

When a tracr comprising a first tracr extension is used, the crRNA may comprise a first flagpole extension. In general any first flagpole extension and first tracr extension may be employed, provided that they are complementary. In embodiments, the first flagpole extension and first tracr extension consist of 3, 4, 5, 6, 7, 8, 9, 10 or more complementary nucleotides.

The first flagpole extension may comprise nucleotides that are complementary, e.g., 80%, 85%, 90%, 95% or 99%, e.g., fully complementary, with nucleotides of the first tracr extension. In some aspects, the first flagpole extension nucleotides that hybridize with complementary nucleotides of the first tracr extension are contiguous. In some aspects, the first flagpole extension nucleotides that hybridize with complementary nucleotides of the first tracr extension are discontinuous, e.g., comprises two or more regions of hybridization separated by nucleotides that do not base pair with nucleotides of the first tracr extension. In some aspects, the first flagpole extension comprises at least 2, 3, 4, 5, 6, 7, 8, 9, 10, 11, 12, 13, 14, 15, 16, 17, 18, 19, 20 or more nucleotides. In some aspects, the first flagpole extension comprises, from 5' to 3': UGCUG (SEQ ID NO: 6586). In some aspects, the first flagpole extension consists of SEQ ID NO: 6586. In some aspects the first flagpole extension comprises nucleic acid that is at least 80%, 85%, 90%, 95% or 99% homology to SEQ ID NO: 6586.

Some or all of the nucleotides of the first tracr extension can have a modification, e.g., modification found in Section XIII herein.

3) The Loop

A loop serves to link the crRNA flagpole region (or optionally the first flagpole extension, when present) with the tracr (or optionally the first tracr extension, when present) of a sgRNA. The loop can link the crRNA flagpole region and tracr covalently or non-covalently. In an embodiment, the linkage is covalent. In an embodiment, the loop covalently couples the crRNA flagpole region and tracr. In an embodiment, the loop covalently couples the first flagpole extension and the first tracr extension. In an embodiment, the loop is, or comprises, a covalent bond interposed between the crRNA flagpole region and the domain of the tracr which hybridizes to the crRNA flagpole region. Typically, the loop comprises one or more, e.g., 2, 3, 4, 5, 6, 7, 8, 9, or 10 nucleotides.

In dgRNA molecules the two molecules can be associated by virtue of the hybridization between at least a portion of the crRNA (e.g., the crRNA flagpole region) and at least a portion of the tracr (e.g., the domain of the tracr which is complementary to the crRNA flagpole region).

A wide variety of loops are suitable for use in sgRNAs. Loops can consist of a covalent bond, or be as short as one or a few nucleotides, e.g., 1, 2, 3, 4, or 5 nucleotides in length. In an embodiment, a loop is 2, 3, 4, 5, 6, 7, 8, 9, 10, 15, 20, or 25 or more nucleotides in length. In an embodiment, a loop is 2 to 50, 2 to 40, 2 to 30, 2 to 20, 2 to 10, or 2 to 5 nucleotides in length. In an embodiment, a loop shares homology with, or is derived from, a naturally occurring sequence. In an embodiment, the loop has at least 50% homology with a loop disclosed herein. In an embodiment, the loop comprises SEQ ID NO: 6588.

Some or all of the nucleotides of the domain can have a modification, e.g., modification described in Section XIII herein.

4) The Second Flagpole Extension

In an embodiment, a dgRNA can comprise additional sequence, 3' to the crRNA flagpole region or, when present, the first flagpole extension, referred to herein as the second flagpole extension. In an embodiment, the second flagpole extension is, 2-10, 2-9, 2-8, 2-7, 2-6, 2-5, or 2-4 nucleotides in length. In an embodiment, the second flagpole extension is 2, 3, 4, 5, 6, 7, 8, 9, or 10 or more nucleotides in length. In an embodiment, the second flagpole extension comprises SEQ ID NO: 6587.

5) The Tracr:

The tracr is the nucleic acid sequence required for nuclease, e.g., Cas9, binding. Without being bound by theory, it is believed that each Cas9 species is associated with a particular tracr sequence. Tracr sequences are utilized in both sgRNA and in dgRNA systems. In an embodiment, the tracr comprises sequence from, or derived from, an S. pyogenes tracr. In some aspects, the tracr has a portion that hybridizes to the flagpole portion of the crRNA, e.g., has sufficient complementarity to the crRNA flagpole region to form a duplexed region under at least some physiological conditions (sometimes referred to herein as the tracr flagpole region or a tracr domain complementary to the crRNA flagpole region). In embodiments, the domain of the tracr that hybridizes with the crRNA flagpole region comprises at least 5, 6, 7, 8, 9, 10, 11, 12, 13, 14, 15, 16, 17, 18, 19, or 20 nucleotides that hybridize with complementary nucleotides of the crRNA flagpole region. In some aspects, the tracr nucleotides that hybridize with complementary nucleotides of the crRNA flagpole region are contiguous. In some aspects, the tracr nucleotides that hybridize with complementary nucleotides of the crRNA flagpole region are discontinuous, e.g., comprises two or more regions of hybridization separated by nucleotides that do not base pair with nucleotides of the crRNA flagpole region. In some aspects, the portion of the tracr that hybridizes to the crRNA flagpole region comprises, from 5' to 3': UAGCAAGUUAAAA (SEQ ID NO: 6597). In some aspects, the portion of the tracr that hybridizes to the crRNA flagpole region comprises, from 5' to 3': UAGCAAGUUUAAA (SEQ ID NO: 6598). In embodiments, the sequence that hybridizes with the crRNA flagpole region is disposed on the tracr 5'- to the sequence of the tracr that additionally binds a nuclease, e.g., a Cas molecule, e.g., a Cas9 molecule.

The tracr further comprises a domain that additionally binds to a nuclease, e.g., a Cas molecule, e.g., a Cas9 molecule. Without being bound by theory, it is believed that Cas9 from different species bind to different tracr sequences. In some aspects, the tracr comprises sequence that binds to a S. pyogenes Cas9 molecule. In some aspects, the tracr comprises sequence that binds to a Cas9 molecule disclosed herein. In some aspects, the domain that additionally binds a Cas9 molecule comprises, from 5' to 3':

```
                                    (SEQ ID NO: 6599)
UAAGGCUAGUCCGUUAUCAACUUGAAAAAGUGGCACCGAGUCGGUGC.
```

In some aspects the domain that additionally binds a Cas9 molecule comprises, from 5' to 3':

```
                                    (SEQ ID NO: 6600)
UAAGGCUAGUCCGUUAUCAACUUGAAAAAGUGGCACCGAGUCGGUGC
UUUU.
```

In some embodiments, the tracr comprises SEQ ID NO: 6589. In some embodiments, the tracr comprises SEQ ID NO: 6590.

Some or all of the nucleotides of the tracr can have a modification, e.g., modification found in Section XIII herein. In embodiments, the gRNA (e.g., the sgRNA or the tracr and/or crRNA of a dgRNA), e.g., any of the gRNA or gRNA components described above, comprises an inverted abasic residue at the 5' end, the 3' end or both the 5' and 3' end of the gRNA. In embodiments, the gRNA (e.g., the sgRNA or the tracr and/or crRNA of a dgRNA), e.g., any of the gRNA or gRNA components described above, comprises one or more phosphorothioate bonds between residues at the 5' end of the polynucleotide, for example, a phosphorthioate bond between the first two 5' residues, between each of the first three 5' residues, between each of the first four 5' residues, or between each of the first five 5' residues. In embodiments, the gRNA or gRNA component may alternatively or additionally comprise one or more phosphorothioate bonds between residues at the 3' end of the polynucleotide, for example, a phosphorthioate bond between the first two 3' residues, between each of the first three 3' residues, between each of the first four 3' residues, or between each of the first five 3' residues. In an embodiment, the gRNA (e.g., the sgRNA or the tracr and/or crRNA of a dgRNA), e.g., any of the gRNA or gRNA components described above, comprises a phosphorothioate bond between each of the first four 5' residues (e.g., comprises, e.g., consists of, three phosphorothioate bonds at the 5' end(s)), and a phosphorothioate bond between each of the first four 3' residues (e.g., comprises, e.g., consists of, three phosphorothioate bonds at the 3' end(s)). In an embodiment, any of the phosphorothioate modifications described above are combined with an inverted abasic residue at the 5' end, the 3' end, or both the 5' and 3' ends of the polynucleotide. In such embodiments, the inverted abasic nucleotide may be linked to the 5' and/or 3' nucleotide by a phosphate bond or a phosphorothioate bond. In embodiments, the gRNA (e.g., the sgRNA or the tracr and/or crRNA of a dgRNA), e.g., any of the gRNA or gRNA components described above, comprises one or more nucleotides that include a 2' O-methyl modification. In embodiments, each of the first 1, 2, 3, or more of the 5' residues comprise a 2' O-methyl modification. In embodiments, each of the first 1, 2, 3, or more of the 3' residues comprise a 2' O-methyl modification. In embodiments, the $4^{th}$-to-terminal, $3^{rd}$-to-terminal, and $2^{nd}$-to-terminal 3' residues comprise a 2' O-methyl modification. In embodiments, each of the first 1, 2, 3 or more of the 5' residues comprise a 2' O-methyl modification, and each of the first 1, 2, 3 or more of the 3' residues comprise a 2' O-methyl modification. In an embodiment, each of the first 3 of the 5' residues comprise a 2' O-methyl modification, and each of the first 3 of the 3' residues comprise a 2' O-methyl modification. In embodiments, each of the first 3 of the 5' residues comprise a 2' O-methyl modification, and the $4^{th}$-to-terminal, 3rd-to-terminal, and $2^{nd}$-to-terminal 3' residues comprise a 2' O-methyl modification. In embodiments, any of the 2' O-methyl modifications, e.g., as described above, may be combined with one or more phosphorothioate modifications, e.g., as described above, and/or one or more inverted abasic modifications, e.g., as described above. In an embodiment, the gRNA (e.g., the sgRNA or the tracr and/or crRNA of a dgRNA), e.g., any of the gRNA or gRNA components described above, comprises, e.g., consists of, a phosphorothioate bond between each of the first four 5' residues (e.g., comprises, e.g., consists of three phosphorothioate bonds at the 5' end of the polynucleotide(s)), a phosphorothioate bond between each of the first four 3' residues (e.g., comprises, e.g., consists of three phosphorothioate bonds at the 5' end of the polynucleotide(s)), a 2' O-methyl modification at each of the first three 5' residues, and a 2' O-methyl modification at each of the first three 3' residues. In an embodiment, the gRNA (e.g., the sgRNA or the tracr and/or crRNA of a dgRNA), e.g., any of the gRNA or gRNA components described above, comprises, e.g., consists of, a phosphorothioate bond between each of the first four 5' residues (e.g., comprises, e.g., consists of three phosphorothioate bonds at the 5' end of the polynucleotide(s)), a phosphorothioate bond between each of the first four 3' residues (e.g., comprises, e.g., consists of three phosphorothioate bonds at the 5' end of the polynucleotide(s)), a 2' O-methyl modification at each of the first three 5' residues, and a 2' O-methyl modification at each of the $4^{th}$-to-terminal, $3^{rd}$-to-terminal, and $2^{nd}$-to-terminal 3' residues.

In an embodiment, the gRNA (e.g., the sgRNA or the tracr and/or crRNA of a dgRNA), e.g., any of the gRNA or gRNA components described above, comprises, e.g., consists of, a phosphorothioate bond between each of the first four 5' residues (e.g., comprises, e.g., consists of three phosphorothioate bonds at the 5' end of the polynucleotide(s)), a phosphorothioate bond between each of the first four 3' residues (e.g., comprises, e.g., consists of three phosphorothioate bonds at the 5' end of the polynucleotide(s)), a 2' modification at each of the first three 5' residues, a 2' O-methyl modification at each of the first three 3' residues, and an additional inverted abasic residue at each of the 5' and 3' ends.

In an embodiment, the gRNA (e.g., the sgRNA or the tracr and/or crRNA of a dgRNA), e.g., any of the gRNA or gRNA components described above, comprises, e.g., consists of, a phosphorothioate bond between each of the first four 5' residues (e.g., comprises, e.g., consists of three phosphorothioate bonds at the 5' end of the polynucleotide(s)), a phosphorothioate bond between each of the first four 3' residues (e.g., comprises, e.g., consists of three phosphorothioate bonds at the 5' end of the polynucleotide(s)), a 2' modification at each of the first three 5' residues, and a 2' O-methyl modification at each of the $4^{th}$-to-terminal, $3^{rd}$-to-terminal, and $2^{nd}$-to-terminal 3' residues, and an additional inverted abasic residue at each of the 5' and 3' ends In embodiments, the gRNA is a dgRNA and comprises, e.g., consists of:
crRNA:
mN*mN*mN*NNNNNNNNNNNNNNNNNGUUUU-AGAGCUAU*mG*mC*mU (SEQ ID NO: 10797), where m indicates a base with 2'O-Methyl modification, * indicates a phosphorothioate bond, and N's indicate the residues of the targeting domain, e.g., as described herein, (optionally with an inverted abasic residue at the 5' and/or 3' terminus); and
tracr:
AACAGCAUAGCAAGUUAAAAUAAGGCUAGU-CCGUUAUCAACUUGAAAAAGUGGCACCGA GUCG-GUGCUUUUUUU (SEQ ID NO: 6660) (optionally with an inverted abasic residue at the 5' and/or 3' terminus).

In embodiments, the gRNA is a dgRNA and comprises, e.g., consists of:
crRNA:
mN*mN*mN*NNNNNGUUUUAGAGCUAU*mG*mC*mU (SEQ ID NO: 10797), where m indicates a base with 2'O-Methyl modification, * indicates a phosphorothioate bond, and N's indicate the residues of the targeting domain, e.g., as described herein, (optionally with an inverted abasic residue at the 5' and/or 3' terminus); and
tracr:
mA*mA*mC*AGCAUAGCAAGUUAAAAUAAGGC-UAGUCCGUUAUCAACUUGAAAAAGUGGC ACCGAGUCGGUGCUUUU*mU*mU*mU (SEQ ID NO: 10798), where m indicates a base with 2'O-Methyl modification, * indicates a phosphorothioate bond, and N's indicate the residues of the targeting domain (optionally with an inverted abasic residue at the 5' and/or 3' terminus).

In embodiments, the gRNA is a dgRNA and comprises, e.g., consists of:
crRNA:
mN*mN*mN*NNNNNNNNNNGUUUUAGAGCUA-UGCUGUU*mU*mU*mG (SEQ ID NO), where m indicates a base with 2'O-Methyl modification, * indicates a phosphorothioate bond, and N's indicate the residues of the targeting domain, e.g., as described herein, (optionally with an inverted abasic residue at the 5' and/or 3' terminus); and
tracr:
AACAGCAUAGCAAGUUAAAAUAAGGCUAGU-CCGUUAUCAACUUGAAAAAGUGGCACCGA GUCG-GUGCUUUUUUU (SEQ ID NO: 6660) (optionally with an inverted abasic residue at the 5' and/or 3' terminus).

In embodiments, the gRNA is a dgRNA and comprises, e.g., consists of:
crRNA:
mN*mN*mN*NNNNNNNNNNNNNNNNGUUUU-AGAGCUAUGCUGUU*mU*mU*mG (SEQ ID NO), where m indicates a base with 2'O-Methyl modification, * indicates a phosphorothioate bond, and N's indicate the residues of the targeting domain, e.g., as described herein, (optionally with an inverted abasic residue at the 5' and/or 3' terminus); and
tracr:
mA*mA*mC*AGCAUAGCAAGUUAAAAUAAGG-CUAGUCCGUUAUCAACUUGAAAAAGUGGC ACCGAGUCGGUGCUUUU*mU*mU*mU (SEQ ID NO: 10798), where m indicates a base with 2'O-Methyl modification, and * indicates a phosphorothioate bond (optionally with an inverted abasic residue at the 5' and/or 3' terminus).

In embodiments, the gRNA is a sgRNA and comprises, e.g., consists of:
mN*mN*mN*NNNNNNNNNNNNNNNNGUUUU-AGAGCUAGAAAUAGCAAGUUAAAAUAAG GCUA-GUCCGUUAUCAACUUGAAAAAGUGGCAC-CGAGUCGGUGCU*mU*mU*mU (SEQ ID NO: 10799), where m indicates a base with 2'O-Methyl modification, * indicates a phosphorothioate bond, and N's indicate the residues of the targeting domain, e.g., as described herein, (optionally with an inverted abasic residue at the 5' and/or 3' terminus).

In embodiments, the gRNA is a sgRNA and comprises, e.g., consists of:
mN*mN*mN GUUUUAGAGCUA-GAAAUAGCAAGUUAAAAUAAG GCUAGU-CCGUUAUCAACUUGAAAAAGUGGCACC-GAGUCGGUGCmU*mU*mU*U, where m indicates a base with 2'O-Methyl modification, * indicates a phosphorothioate bond, and N's indicate the residues of the targeting domain, e.g., as described herein, (optionally with an inverted abasic residue at the 5' and/or 3' terminus).

6) First Tracr Extension

Where the gRNA comprises a first flagpole extension, the tracr may comprise a first tracr extension. The first tracr extension may comprise nucleotides that are complementary, e.g., 80%, 85%, 90%, 95% or 99%, e.g., fully complementary, with nucleotides of the first flagpole extension. In some aspects, the first tracr extension nucleotides that hybridize with complementary nucleotides of the first flagpole extension are contiguous. In some aspects, the first tracr extension nucleotides that hybridize with complementary nucleotides of the first flagpole extension are discontinuous, e.g., comprises two or more regions of hybridization separated by nucleotides that do not base pair with nucleotides of the first flagpole extension. In some aspects, the first tracr extension comprises at least 2, 3, 4, 5, 6, 7, 8, 9, 10, 11, 12, 13, 14, 15, 16, 17, 18, 19, 20 or more nucleotides. In some aspects, the first tracr extension comprises SEQ ID NO: 6591. In some aspects the first tracr extension comprises nucleic acid that is at least 80%, 85%, 90%, 95% or 99% homology to SEQ ID NO: 6591.

Some or all of the nucleotides of the first tracr extension can have a modification, e.g., modification found in Section XIII herein.

In some embodiments, the sgRNA may comprise, from 5' to 3', disposed 3' to the targeting domain:

a)

(SEQ ID NO: 6601)
GUUUUAGAGCUAGAAAUAGCAAGUUAAAAUAAGGCUAGUCCGUUAUC

AACUUGAAAAAGUGGCACCGAGUCGGUGC;

b)

(SEQ ID NO: 6602)
GUUUAAGAGCUAGAAAUAGCAAGUUUAAAUAAGGCUAGUCCGUUAUC

AACUUGAAAAAGUGGCACCGAGUCGGUGC;

c)

(SEQ ID NO: 6603)
GUUUUAGAGCUAUGCUGGAAACAGCAUAGCAAGUUAAAAUAAGGCUA

GUCCGUUAUCAACUUGAAAAAGUGGCACCGAGUCGGUGC;

d)

(SEQ ID NO: 6604)
GUUUAAGAGCUAUGCUGGAAACAGCAUAGCAAGUUUAAAUAAGGCUA

GUCCGUUAUCAACUUGAAAAAGUGGCACCGAGUCGGUGC;

e) any of a) to d), above, further comprising, at the 3' end, at least 1, 2, 3, 4, 5, 6 or 7 uracil (U) nucleotides, e.g., 1, 2, 3, 4, 5, 6, or 7 uracil (U) nucleotides;
f) any of a) to d), above, further comprising, at the 3' end, at least 1, 2, 3, 4, 5, 6 or 7 adenine (A) nucleotides, e.g., 1, 2, 3, 4, 5, 6, or 7 adenine (A) nucleotides; or
g) any of a) to f), above, further comprising, at the 5' end (e.g., at the 5' terminus, e.g., 5' to the targeting domain), at least 1, 2, 3, 4, 5, 6 or 7 adenine (A) nucleotides, e.g., 1, 2, 3, 4, 5, 6, or 7 adenine (A) nucleotides.

In an embodiment, a sgRNA of the invention comprises, e.g., consists of, from 5' to 3': [targeting domain]—

(SEQ ID NO: 7811)
GUUUUAGAGCUAGAAAUAGCAAGUUAAAAUAAGGCUAGUCCGUUAUC

AACUUGAAAAAGUGGCACCGAGUCGGUGCUUUU.

In an embodiment, a sgRNA of the invention comprises, e.g., consists of, from 5' to 3': [targeting domain]—

(SEQ ID NO: 7807)
GUUUAAGAGCUAUGCUGGAAACAGCAUAGCAAGUUUAAAUAAGGCUA

GUCCGUUAUCAACUUGAAAAAGUGGCACCGAGUCGGUGCUUUU.

In embodiments, any of a) to g) above is disposed directly 3' to the targeting domain.

In some embodiments, the dgRNA may comprise:

A crRNA comprising, from 5' to 3', preferably disposed directly 3' to the targeting domain:

a) GUUUUAGAGCUA (SEQ ID NO: 6584);
b) GUUUAAGAGCUA (SEQ ID NO: 6585);
c) GUUUUAGAGCUAUGCUG (SEQ ID NO: 6605);
d) GUUUAAGAGCUAUGCUG (SEQ ID NO: 6606);
e) GUUUUAGAGCUAUGCUGUUUUG (SEQ ID NO: 6607);
f) GUUUAAGAGCUAUGCUGUUUUG (SEQ ID NO: 6608); or
g) GUUUUAGAGCUAUGCU (SEQ ID NO: 7806):

and a tracr comprising, from 5' to 3':

a)

(SEQ ID NO: 6589)
UAGCAAGUUAAAAUAAGGCUAGUCCGUUAUCAACUUGAAAAAGUGGCACC

GAGUCGGUGC;

b)

(SEQ ID NO: 6590)
UAGCAAGUUUAAAUAAGGCUAGUCCGUUAUCAACUUGAAAAAGUGGCACC

GAGUCGGUGC;

c)

(SEQ ID NO: 6609)
CAGCAUAGCAAGUUAAAAUAAGGCUAGUCCGUUAUCAACUUGAAAAAGUG

GCACCGAGUCGGUGC;

d)

(SEQ ID NO: 6610)
CAGCAUAGCAAGUUUAAAUAAGGCUAGUCCGUUAUCAACUUGAAAAAGUG

GCACCGAGUCGGUGC;

e)

(SEQ ID NO: 6660)
AACAGCAUAGCAAGUUAAAAUAAGGCUAGUCCGUUAUCAACUUGAAAAAG

UGGCACCGAGUCGGUGCUUUUUUU;

f)

(SEQ ID NO: 6661)
AACAGCAUAGCAAGUUUAAAUAAGGCUAGUCCGUUAUCAACUUGAAAAAG

UGGCACCGAGUCGGUGCUUUUUUU;

g)

(SEQ ID NO: 7807)
GUUUAAGAGCUAUGCUGGAAACAGCAUAGCAAGUUUAAAUAAGGCUAGUC

CGUUAUCAACUUGAAAAAGUGGCACCGAGUCGGUGCUUUU;

h)

(SEQ ID NO: 7808)
AGCAUAGCAAGUUAAAAUAAGGCUAGUCCGUUAUCAACUUGAAAAAGUGG

CACCGAGUCGGUGCUUU;

i)

(SEQ ID NO: 7809)
GUUGGAACCAUUCAAAACAGCAUAGCAAGUUAAAAUAAGGCUAGUCCGUU

AUCAACUUGAAAAAGUGGCACCGAGUCGGUGCUUU;

j)

(SEQ ID NO: 7820)
AACAGCAUAGCAAGUUAAAAUAAGGCUAGUCCGUUAUCAACUUGAAAAAG

UGGCACCGAGUCGGUGC;

k) any of a) to j), above, further comprising, at the 3' end, at least 1, 2, 3, 4, 5, 6 or 7 uracil (U) nucleotides, e.g., 1, 2, 3, 4, 5, 6, or 7 uracil (U) nucleotides;

l) any of a) to j), above, further comprising, at the 3' end, at least 1, 2, 3, 4, 5, 6 or 7 adenine (A) nucleotides, e.g., 1, 2, 3, 4, 5, 6, or 7 adenine (A) nucleotides; or m) any of a) to l), above, further comprising, at the 5' end (e.g., at the 5' terminus), at least 1, 2, 3, 4, 5, 6 or 7 adenine (A) nucleotides, e.g., 1, 2, 3, 4, 5, 6, or 7 adenine (A) nucleotides.

In an embodiment, the sequence of k), above comprises the 3' sequence UUUUUU, e.g., if a U6 promoter is used for transcription. In an embodiment, the sequence of k), above, comprises the 3' sequence UUUU, e.g., if an HI promoter is used for transcription. In an embodiment, sequence of k), above, comprises variable numbers of 3' U's depending, e.g., on the termination signal of the pol-III promoter used. In an embodiment, the sequence of k), above, comprises variable 3' sequence derived from the DNA template if a T7 promoter is used. In an embodiment, the sequence of k), above, comprises variable 3' sequence derived from the DNA template, e.g., if in vitro transcription is used to generate the RNA molecule. In an embodiment, the sequence of k), above, comprises variable 3' sequence derived from the DNA template, e.g, if a pol-II promoter is used to drive transcription.

In an embodiment, the crRNA comprises SEQ ID NO: 6607 and the tracr comprises, e.g., consists of (SEQ ID NO: 6660)
AACAGCAUAGCAAGUUAAAAUAAGGCUAGUCCGUUAUCAACUUGAAAAAG

UGGCACCGAGUCGGUGCUUUUUUU.

In an embodiment, the crRNA comprises SEQ ID NO: 6608 and the tracr comprises, e.g., consists of, (SEQ ID NO: 6661)
AACAGCAUAGCAAGUUUAAAUAAGGCUAGUCCGUUAUCAACUUGAAAAAG

UGGCACCGAGUCGGUGCUUUUUUU.

In an embodiment, the crRNA comprises, e.g., consists of, a targeting domain and, disposed 3' to the targeting domain (e.g., disposed directly 3' to the targeting domain), a sequence comprising, e.g., consisting of, GUUUUAGAGC-UAUGCU (SEQ ID NO: 7806), and the tracr comprises, e.g., consists of, (SEQ ID NO: 7807)
GUUUAAGAGCUAUGCUGGAAACAGCAUAGCAAGUUUAAAUAAGGCUAGUC

CGUUAUCAACUUGAAAAAGUGGCACCGAGUCGGUGCUUUU.

In an embodiment, the crRNA comprises, e.g., consists of, a targeting domain and, disposed 3' to the targeting domain (e.g., disposed directly 3' to the targeting domain), a sequence comprising, e.g., consisting of, GUUUUAGAGC-UAUGCU (SEQ ID NO: 7806), and the tracr comprises, e.g., consists of, (SEQ ID NO: 7808)
AGCAUAGCAAGUUAAAAUAAGGCUAGUCCGUUAUCAACUUGAAAAAGUGG

CACCGAGUCGGUGCUUU.

In an embodiment, the crRNA comprises, e.g., consists of, a targeting domain and, disposed 3' to the targeting domain (e.g., disposed directly 3' to the targeting domain), a sequence comprising, e.g., consisting of, GUUUUAGAGC-UAUGCUGUUUUG (SEQ ID NO: 6607), and the tracr comprises, e.g., consists of, (SEQ ID NO: 7809)
GUUGGAACCAUUCAAAACAGCAUAGCAAGUUAAAAUAAGGCUAGUCCGUU

AUCAACUUGAAAAAGUGGCACCGAGUCGGUGCUUU.

7) Targeting Domains Useful for Altering Expression of Allogeneic T Cell Targets, Inhibitory Molecules and/or Downstream Effectors of an Inhibitory Molecule Provided in the tables below are targeting domains for gRNA molecules for use in the compositions and methods of the present invention, for example, in altering expression of or altering a Allogeneic T Cell Target gene, Inhibitory Molecule gene and/or a Downstream Effectors of An Inhibitory Molecule gene.

Lengthy table referenced here

US12037583-20240716-T00001

Please refer to the end of the specification for access instructions.

Lengthy table referenced here

US12037583-20240716-T00002

Please refer to the end of the specification for access instructions.

Exemplary preferred gRNA targeting domains useful in the compositions and methods of the invention are described in the tables below.

TABLE 3

| gRNA Targeting Domains for human B2M | | | | | |
|---|---|---|---|---|---|
| Id. | Locations | Target | Strand | gRNA Targeting Domain Sequence | SEQ ID NO: |
| CR00438 | Chr15: 44711472-44711494 | B2M | + | CACGCGUUUAAUAUAAGUGG | 5492 |
| CR00439 | Chr15: 44711483-44711505 | B2M | + | UAUAAGUGGAGGCGUCGCGC | 5493 |
| CR00440 | Chr15: 44711486-44711508 | B2M | + | AAGUGGAGGCGUCGCGCUGG | 5494 |
| CR00441 | Chr15: 44711534-44711556 | B2M | + | GGCCGAGAUGUCUCGCUCCG | 5495 |
| CR00442 | Chr15: 44711536-44711558 | B2M | - | GGCCACGGAGCGAGACAUCU | 5496 |
| CR00443 | Chr15: 44711551-44711573 | B2M | - | CGCGAGCACAGCUAAGGCCA | 5497 |
| CR00444 | Chr15: 44711557-44711579 | B2M | - | GAGUAGCGCGAGCACAGCUA | 5498 |
| CR00445 | Chr15: 44711591-44711613 | B2M | - | ACUCACGCUGGAUAGCCUCC | 5499 |
| CR00446 | Chr15: 44711603-44711625 | B2M | - | AGGGUAGGAGAGACUCACGC | 5500 |
| CR00447 | Chr15: 44715412-44715434 | B2M | + | CUCAGGUACUCCAAAGAUUC | 5501 |
| CR00448 | Chr15: 44715422-44715444 | B2M | - | CGUGAGUAAACCUGAAUCUU | 5502 |
| CR00449 | Chr15: 44715507-44715529 | B2M | - | CAGUAAGUCAACUUCAAUGU | 5503 |
| CR00450 | Chr15: 44715567-44715589 | B2M | + | ACUUGUCUUUCAGCAAGGAC | 5504 |
| CR00451 | Chr15: 44715645-44715667 | B2M | - | AGUCACAUGGUUCACACGGC | 5505 |
| CR00452 | Chr15: 44715649-44715671 | B2M | - | ACAAAGUCACAUGGUUCACA | 5506 |
| CR00453 | Chr15: 44715672-44715694 | B2M | + | CACAGCCCAAGAUAGUUAAG | 5507 |
| CR00454 | Chr15: 44715673-44715695 | B2M | + | ACAGCCCAAGAUAGUUAAGU | 5508 |
| CR00455 | Chr15: 44715677-44715699 | B2M | - | UUACCCCACUUAACUAUCUU | 5509 |
| CR00456 | Chr15: 44715678-44715700 | B2M | - | CUUACCCCACUUAACUAUCU | 5510 |
| CR00457 | Chr15: 44717599-44717621 | B2M | + | AGGUUUGAAGAUGCCGCAUU | 5511 |
| CR00458 | Chr15: 44717604-44717626 | B2M | + | UGAAGAUGCCGCAUUUGGAU | 5512 |
| CR00459 | Chr15: 44717612-44717634 | B2M | - | GAAUUCAUCCAAUCCAAAUG | 5513 |
| CR00460 | Chr15: 44717681-44717703 | B2M | + | ACACUUUAUGCACAAAAUGU | 5514 |

TABLE 3-continued gRNA Targeting Domains for human B2M

| Id. | Locations | Target | Strand | gRNA Targeting Domain Sequence | SEQ ID NO: |
|---|---|---|---|---|---|
| CR00461 | Chr15: 44717763-44717785 | B2M | − | CUGCUCAGAUACAUCAAACA | 5515 |
| CR00462 | Chr15: 44717764-44717786 | B2M | + | CAUGUUUGAUGUAUCUGAGC | 5516 |
| CR00463 | Chr15: 44717776-44717798 | B2M | + | AUCUGAGCAGGUUGCUCCAC | 5517 |
| CR00464 | Chr15: 44717789-44717811 | B2M | + | GCUCCACAGGUAGCUCUAGG | 5518 |
| CR00465 | Chr15: 44717805-44717827 | B2M | + | UAGGAGGGCUGGCAACUUAG | 5519 |
| CR00466 | Chr15: 44717808-44717830 | B2M | + | GAGGGCUGGCAACUUAGAGG | 5520 |
| CR00467 | Chr15: 44717809-44717831 | B2M | + | AGGGCUGGCAACUUAGAGGU | 5521 |
| CR00468 | Chr15: 44717810-44717832 | B2M | + | GGGCUGGCAACUUAGAGGUG | 5522 |
| CR00469 | Chr15: 44717851-44717873 | B2M | − | UCUGACCAAGAUGUUGAUGU | 5523 |
| CR00470 | Chr15: 44717939-44717961 | B2M | − | UCUAAGCAGAGUAUGUAAAU | 5524 |
| CR00471 | Chr15: 44717981-44718003 | B2M | + | AAUAUAAUUGACAGGAUUAU | 5525 |
| CR00472 | Chr15: 44718056-44718078 | B2M | + | CUUAUACAUUUGAUAAAGUA | 5526 |
| CR00473 | Chr15: 44718076-44718098 | B2M | + | AGGCAUGGUUGUGGUUAAUC | 5527 |

In the various aspects of the invention, the gRNA molecule may include a targeting domain listed above. In an embodiment, the targeting domain of the gRNA of the invention comprises, e.g. consists of, the targeting domain of CR00465. In an embodiment, the targeting domain of the gRNA of the invention comprises, e.g. consists of, the targeting domain of CR00443. In an embodiment, the targeting domain of the gRNA of the invention comprises, e.g. consists of, the targeting domain of CR00445. In an embodiment, the targeting domain of the gRNA of the invention comprises, e.g. consists of, the targeting domain of CR00444. In an embodiment, the targeting domain of the gRNA of the invention comprises, e.g. consists of, the targeting domain of CR00449. In an embodiment, the targeting domain of the gRNA of the invention comprises, e.g. consists of, the targeting domain of CR00442. In an embodiment, the targeting domain of the gRNA of the invention comprises, e.g. consists of, the targeting domain of CR00453. In an embodiment, the targeting domain of the gRNA of the invention comprises, e.g. consists of, the targeting domain of CR00461. In an embodiment, the targeting domain of the gRNA of the invention comprises, e.g. consists of, the targeting domain of CR00439. In an embodiment, the targeting domain of the gRNA of the invention comprises, e.g. consists of, the targeting domain of CR00452. In an embodiment, the targeting domain of the gRNA of the invention comprises, e.g. consists of, the targeting domain of CR00455. In an embodiment, the targeting domain of the gRNA of the invention comprises, e.g. consists of, the targeting domain of CR00463. In an embodiment, the targeting domain of the gRNA of the invention comprises, e.g. consists of, the targeting domain of CR00467. In an embodiment, the targeting domain of the gRNA of the invention comprises, e.g. consists of, the targeting domain of CR00466. In an embodiment, the targeting domain of the gRNA of the invention comprises, e.g. consists of, the targeting domain of CR00446. In an embodiment, the targeting domain of the gRNA of the invention comprises, e.g. consists of, the targeting domain of CR00440. In an embodiment, the targeting domain of the gRNA of the invention comprises, e.g. consists of, the targeting domain of CR00454. In an embodiment, the targeting domain of the gRNA of the invention comprises, e.g. consists of, the targeting domain of CR00460. In an embodiment, the targeting domain of the gRNA of the invention comprises, e.g. consists of, the targeting domain of CR00438. In an embodiment, the targeting domain of the gRNA of the invention comprises, e.g. consists of, the targeting domain of CR00439. Such gRNA molecules, and combinations thereof, are suitable for use in, for example, the CRISPR systems, methods and cells and other aspects of the invention described herein.

TABLE 4 gRNA targeting domain sequences for human T-Cell Receptor Alpha (TRAC)

| Id. | Target Name | Strand | Genomic Information | gRNA Targeting Domain Sequence | SEQ ID NO: |
|---|---|---|---|---|---|
| CR000920 | TRAC | + | Chr14: 22281089-22281111 | CUCAAGGUUCAGAUCAGAAG | 5528 |
| CR000921 | TRAC | + | Chr14: 22281092-22281114 | AAGGUUCAGAUCAGAAGAGG | 5529 |
| CR000922 | TRAC | + | Chr14: 22281111-22281133 | GAGGCUUCUCACCCUGCAGC | 5530 |
| CR000923 | TRAC | + | Chr14: 22281112-22281134 | AGGCUUCUCACCCUGCAGCA | 5531 |
| CR000924 | TRAC | - | Chr14: 22281122-22281144 | GCUCACAGGUCCCUGCUGCA | 5532 |
| CR000925 | TRAC | - | Chr14: 22281123-22281145 | UGCUCACAGGUCCCUGCUGC | 5533 |
| CR000926 | TRAC | + | Chr14: 22281126-22281148 | GCAGCAGGGACCUGUGAGCA | 5534 |
| CR000927 | TRAC | + | Chr14: 22281136-22281158 | CCUGUGAGCAUGGCAUGCCC | 5535 |
| CR000928 | TRAC | - | Chr14: 22281136-22281158 | CCAGGGCAUGCCAUGCUCAC | 5536 |
| CR000929 | TRAC | - | Chr14: 22281153-22281175 | CAAGUGCCCACAGGAAGCCA | 5537 |
| CR000930 | TRAC | - | Chr14: 22281154-22281176 | ACAAGUGCCCACAGGAAGCC | 5538 |
| CR000931 | TRAC | - | Chr14:22281162-22281184 | UGGAGAUCACAAGUGCCCAC | 5539 |
| CR000932 | TRAC | - | Chr14: 22281182-22281204 | GCCUUCCUUACCAAGACAGG | 5540 |
| CR000933 | TRAC | - | Chr14: 22281185-22281207 | UGCGCCUUCCUUACCAAGAC | 5541 |
| CR000934 | TRAC | + | Chr14:22281432-22281454 | CUUUCCCACAGAAUUUAGCA | 5542 |
| CR000935 | TRAC | + | Chr14: 22281477-22281499 | ACCAGAGAUGUCUGUGCAGG | 5543 |
| CR000936 | TRAC | - | Chr14: 22281478-22281500 | GCCUCCUGCACAGACAUCUC | 5544 |
| CR000937 | TRAC | - | Chr14: 22281506-22281528 | AUAUGUGCAGCUCAGGGUCA | 5545 |
| CR000938 | TRAC | - | Chr14: 22281512-22281534 | GGUGUCAUAUGUGCAGCUCA | 5546 |
| CR000939 | TRAC | - | Chr14: 22281513-22281535 | UGGUGUCAUAUGUGCAGCUC | 5547 |
| CR000940 | TRAC | - | Chr14:22281533-22281555 | UAAAUAAUAAUCACUCUCAC | 5548 |
| CR000941 | TRAC | + | Chr14: 22281539-22281561 | AGAGUGAUUAUUAUUUAUUC | 5549 |
| CR000942 | TRAC | + | Chr14: 22281560-22281582 | GGUACAAGCAGCCUCCCAGC | 5550 |
| CR000943 | TRAC | - | Chr14: 22281571-22281593 | AGAAUCAUCUGCCUGCUGGG | 5551 |
| CR000944 | TRAC | - | Chr14: 22281574-22281596 | ACGAGAAUCAUCUGCCUGCU | 5552 |

TABLE 4-continued gRNA targeting domain sequences for human T-Cell Receptor Alpha (TRAC)

| Id. | Target Name | Strand | Genomic Information | gRNA Targeting Domain Sequence | SEQ ID NO: |
|---|---|---|---|---|---|
| CR000945 | TRAC | - | Chr14: 22281575-22281597 | AACGAGAAUCAUCUGCCUGC | 5553 |
| CR000946 | TRAC | - | Chr14: 22281603-22281625 | UCUGUUGCUUAUAAGCUUCU | 5554 |
| CR000947 | TRAC | - | Chr14: 22338946-22338968 | GUUGGUGAGGUUGAUAAAUU | 5555 |
| CR000948 | TRAC | - | Chr14: 22338959-22338981 | GCUGUAUGUGUGAGUUGGUG | 5556 |
| CR000949 | TRAC | + | Chr14: 22338963-22338985 | ACCAACUCACACAUACAGCC | 5557 |
| CR000950 | TRAC | + | Chr14: 22338964-22338986 | CCAACUCACACAUACAGCCA | 5558 |
| CR000951 | TRAC | - | Chr14: 22338981-22339003 | AGCACAAGAAUAUAGAUCCC | 5559 |
| CR000952 | TRAC | + | Chr14: 22338992-22339014 | UAUUCUUGUGCUCUCAGAGA | 5560 |
| CR000953 | TRAC | + | Chr14: 22513941-22513963 | GGAAACACACCUCUUGUCUU | 5561 |
| CR000954 | TRAC | + | Chr14: 22513946-22513968 | CACACCUCUUGUCUUUGGAA | 5562 |
| CR000955 | TRAC | + | Chr14: 22513947-22513969 | ACACCUCUUGUCUUUGGAAA | 5563 |
| CR000956 | TRAC | - | Chr14: 22513950-22513972 | GUGCCCUUUCCAAAGACAAG | 5564 |
| CR000957 | TRAC | - | Chr14: 22547504-22547526 | ACACGGCAGGGUCAGGGUUC | 5565 |
| CR000958 | TRAC | - | Chr14: 22547511-22547533 | AGCUGGUACACGGCAGGGUC | 5566 |
| CR000959 | TRAC | - | Chr14: 22547516-22547538 | CUCUCAGCUGGUACACGGCA | 5567 |
| CR000960 | TRAC | - | Chr14: 22547517-22547539 | UCUCUCAGCUGGUACACGGC | 5568 |
| CR000961 | TRAC | - | Chr14: 22547521-22547543 | AGAGUCUCUCAGCUGGUACA | 5569 |
| CR000962 | TRAC | - | Chr14: 22547528-22547550 | UGGAUUUAGAGUCUCUCAGC | 5570 |
| CR000963 | TRAC | - | Chr14: 22547548-22547570 | UAGGCAGACAGACUUGUCAC | 5571 |
| CR000964 | TRAC | - | Chr14: 22547567-22547589 | GAGAAUCAAAAUCGGUGAAU | 5572 |
| CR000965 | TRAC | - | Chr14: 22547575-22547597 | AUUUGUUUGAGAAUCAAAAU | 5573 |
| CR000966 | TRAC | + | Chr14: 22547591-22547613 | AACAAAUGUGUCACAAAGUA | 5574 |
| CR000967 | TRAC | + | Chr14: 22547635-22547657 | ACAAAACUGUGCUAGACAUG | 5575 |
| CR000968 | TRAC | + | Chr14: 22547642-22547664 | UGUGCUAGACAUGAGGUCUA | 5576 |
| CR000969 | TRAC | + | Chr14: 22547666-22547688 | CUUCAAGAGCAACAGUGCUG | 5577 |

TABLE 4-continued gRNA targeting domain sequences for human T-Cell Receptor Alpha (TRAC)

| Id. | Target Name | Strand | Genomic Information | gRNA Targeting Domain Sequence | SEQ ID NO: |
|---|---|---|---|---|---|
| CR000970 | TRAC | + | Chr14: 22547671-22547693 | AGAGCAACAGUGCUGUGGCC | 5578 |
| CR000971 | TRAC | - | Chr14: 22547689-22547711 | AAAGUCAGAUUUGUUGCUCC | 5579 |
| CR000972 | TRAC | - | Chr14: 22547725-22547747 | UGGAAUAAUGCUGUUGUUGA | 5580 |
| CR000973 | TRAC | - | Chr14: 22547745-22547767 | CUGGGGAAGAAGGUGUCUUC | 5581 |
| CR000974 | TRAC | - | Chr14: 22547762-22547784 | AGCUGCCCUUACCUGGGCUG | 5582 |
| CR000975 | TRAC | - | Chr14: 22547763-22547785 | AAGCUGCCCUUACCUGGGCU | 5583 |
| CR000976 | TRAC | - | Chr14: 22547764-22547786 | AAAGCUGCCCUUACCUGGGC | 5584 |
| CR000977 | TRAC | - | Chr14: 22547768-22547790 | CACCAAAGCUGCCCUUACCU | 5585 |
| CR000978 | TRAC | - | Chr14: 22547769-22547791 | GCACCAAAGCUGCCCUUACC | 5586 |
| CR000979 | TRAC | + | Chr14: 22549633-22549655 | AAGUUCCUGUGAUGUCAAGC | 5587 |
| CR000980 | TRAC | - | Chr14: 22549638-22549660 | CUCGACCAGCUUGACAUCAC | 5588 |
| CR000981 | TRAC | - | Chr14: 22550558-22550580 | CUGACAGGUUUUGAAAGUUU | 5589 |
| CR000982 | TRAC | + | Chr14: 22550565-22550587 | UUUCAAAACCUGUCAGUGAU | 5590 |
| CR000983 | TRAC | + | Chr14: 22550566-22550588 | UUCAAAACCUGUCAGUGAUU | 5591 |
| CR000984 | TRAC | - | Chr14: 22550573-22550595 | UUCGGAACCCAAUCACUGAC | 5592 |
| CR000985 | TRAC | + | Chr14: 22550591-22550613 | CCGAAUCCUCCUCCUGAAAG | 5593 |
| CR000986 | TRAC | - | Chr14: 22550591-22550613 | CCACUUUCAGGAGGAGGAUU | 5594 |
| CR000987 | TRAC | + | Chr14: 22550595-22550617 | AUCCUCCUCCUGAAAGUGGC | 5595 |
| CR000988 | TRAC | + | Chr14: 22550596-22550618 | UCCUCCUCCUGAAAGUGGCC | 5596 |
| CR000989 | TRAC | - | Chr14: 22550597-22550619 | ACCCGGCCACUUUCAGGAGG | 5597 |
| CR000990 | TRAC | - | Chr14: 22550600-22550622 | UAAACCCGGCCACUUUCAGG | 5598 |
| CR000991 | TRAC | - | Chr14: 22550603-22550625 | GAUUAAACCCGGCCACUUUC | 5599 |
| CR000992 | TRAC | - | Chr14: 22550614-22550636 | CGUCAUGAGCAGAUUAAACC | 5600 |
| CR000993 | TRAC | + | Chr14: 22550620-22550642 | UUAAUCUGCUCAUGACGCUG | 5601 |
| CR000994 | TRAC | + | Chr14: 22550626-22550648 | UGCUCAUGACGCUGCGGCUG | 5602 |

TABLE 4-continued gRNA targeting domain sequences for human T-Cell Receptor Alpha (TRAC)

| Id. | Target Name | Strand | Genomic Information | gRNA Targeting Domain Sequence | SEQ ID NO: |
|---|---|---|---|---|---|
| CR000995 | TRAC | - | Chr14: 22550650-22550672 | UCAAGGCCCCUCACCUCAGC | 5603 |
| CR000996 | TRAC | - | Chr14: 22551620-22551642 | AGGAAGGAGCGAGGGAGCAC | 5604 |
| CR000997 | TRAC | - | Chr14: 22551628-22551650 | CAAUGCAGAGGAAGGAGCGA | 5605 |
| CR000998 | TRAC | - | Chr14: 22551629-22551651 | GCAAUGCAGAGGAAGGAGCG | 5606 |
| CR000999 | TRAC | - | Chr14: 22551636-22551658 | AAGAGGGGCAAUGCAGAGGA | 5607 |
| CR001000 | TRAC | - | Chr14: 22551640-22551662 | GGAGAAGAGGGGCAAUGCAG | 5608 |
| CR001001 | TRAC | - | Chr14: 22551653-22551675 | UCUGUUUGGAGAGGGAGAAG | 5609 |
| CR001002 | TRAC | + | Chr14: 22551655-22551677 | UCUUCUCCCUCUCCAAACAG | 5610 |
| CR001003 | TRAC | + | Chr14: 22551656-22551678 | CUUCUCCCUCUCCAAACAGA | 5611 |
| CR001004 | TRAC | - | Chr14: 22551661-22551683 | GAGUUCCCUCUGUUGGAGA | 5612 |
| CR001005 | TRAC | - | Chr14: 22551662-22551684 | AGAGUUCCCUCUGUUUGGAG | 5613 |
| CR001006 | TRAC | - | Chr14: 22551667-22551689 | GUAGGAGAGUUCCCUCUGUU | 5614 |
| CR001007 | TRAC | + | Chr14: 22551678-22551700 | GAACUCUCCUACCCCAAGG | 5615 |
| CR001008 | TRAC | - | Chr14: 22551685-22551707 | GCUUUCACCUCCUUGGGGU | 5616 |
| CR001009 | TRAC | - | Chr14: 22551689-22551711 | AGCAGCUUUCACCUCCUUGG | 5617 |
| CR001010 | TRAC | - | Chr14: 22551690-22551712 | UAGCAGCUUUCACCUCCUUG | 5618 |
| CR001011 | TRAC | - | Chr14: 22551691-22551713 | GUAGCAGCUUUCACCUCCUU | 5619 |
| CR001012 | TRAC | + | Chr14: 22551710-22551732 | CUACCACCUCUGUGCCCCC | 5620 |
| CR001013 | TRAC | - | Chr14: 22551713-22551735 | UUGCCGGGGGGCACAGAGG | 5621 |
| CR001014 | TRAC | - | Chr14: 22551716-22551738 | GCAUUGCCGGGGGGCACAG | 5622 |
| CR001015 | TRAC | - | Chr14: 22551724-22551746 | AGUUGGUGGCAUUGCCGGGG | 5623 |

In the various aspects of the invention, the gRNA molecule may include a targeting domain listed above. In an embodiment, the targeting domain of the gRNA of the invention comprises, e.g. consists of, the targeting domain of CR000961. In an embodiment, the targeting domain of the gRNA of the invention comprises, e.g. consists of, the targeting domain of CR000977. In an embodiment, the targeting domain of the gRNA of the invention comprises, e.g. consists of, the targeting domain of CR000984. In an embodiment, the targeting domain of the gRNA of the invention comprises, e.g. consists of, the targeting domain of CR000993. In an embodiment, the targeting domain of the gRNA of the invention comprises, e.g. consists of, the targeting domain of CR000981. In an embodiment, the targeting domain of the gRNA of the invention comprises, e.g. consists of, the targeting domain of CR000992. In an embodiment, the targeting domain of the gRNA of the invention comprises, e.g. consists of, the targeting domain of CR000986. In an embodiment, the targeting domain of the gRNA of the invention comprises, e.g. consists of, the targeting domain of CR000963. In an embodiment, the targeting domain of the gRNA of the invention comprises, e.g. consists of, the targeting domain of CR000985. In an embodiment, the targeting domain of the gRNA of the invention comprises, e.g. consists of, the targeting domain of CR000966. In an embodiment, the targeting domain of the gRNA of the invention comprises, e.g. consists of, the targeting domain of CR000990. In an embodiment, the targeting domain of the gRNA of the invention comprises, e.g. consists of, the targeting domain of CR000978. In an embodiment, the targeting domain of the gRNA of the invention comprises, e.g. consists of, the targeting domain of CR000991. In an embodiment, the targeting domain of the gRNA of the invention comprises, e.g. consists of, the targeting domain of CR000983. In an embodiment, the targeting domain of the gRNA of the invention comprises, e.g. consists of, the targeting domain of CR000960. In an embodiment, the targeting domain of the gRNA of the invention comprises, e.g. consists of, the targeting domain of CR001002. In an embodiment, the targeting domain of the gRNA of the invention comprises, e.g. consists of, the targeting domain of CR001000. In an embodiment, the targeting domain of the gRNA of the invention comprises, e.g. consists of, the targeting domain of CR001009. In an embodiment, the targeting domain of the gRNA of the invention comprises, e.g. consists of, the targeting domain of CR001011. In an embodiment, the targeting domain of the gRNA of the invention comprises, e.g. consists of, the targeting domain of CR001012. Such gRNA molecules, and combinations thereof, are suitable for use in, for example, the CRISPR systems, methods and cells and other aspects of the invention described herein.

TABLE 5 gRNA targeting domains for human T-Cell Receptor Beta (Constant Domain 1 and Constant Domain 2)

| Id. | Target Name | gRNA Targeting Domain Sequence | Genomic Information | SEQ ID NO: |
|---|---|---|---|---|
| CR000728 | TRBC1 | CAGGGAAGAAGCCUGUGGCC | Chr7: 142791779-142791801 | 5624 |
| CR000729 | TRBC1 | GUGGUCAGGGAAGAAGCCUG | Chr7: 142791784-142791806 | 5625 |
| CR000730 | TRBC1 | CUGACCACGUGGAGCUGAGC | Chr7: 142791799-142791821 | 5626 |
| CR000731 | TRBC1 | CACGGACCCGCAGCCCCUCA | Chr7: 142791857-142791879 | 5627 |
| CR000732 | TRBC1 | GGUGCACAGUGGGGUCAGCA | Chr7: 142791839-142791861 | 5628 |
| CR000733 | TRBC1 | GACGGGUUUGGCCCUAUCCU | Chr7: 142792015-142792037 | 5629 |
| CR000734 | TRBC1 | UGGCUCAAACACAGCGACCU | Chr7: 142791712-142791734 | 5630 |
| CR000735 | TRBC1 | AGGCUUCUUCCCUGACCACG | Chr7: 142791788-142791810 | 5631 |
| CR000736 | TRBC1 | CAGCUCAGCUCCACGUGGUC | Chr7: 142791798-142791820 | 5632 |
| CR000737 | TRBC1 | GCGCUGACGAUCUGGGUGAC | Chr7: 142792032-142792054 | 5633 |
| CR000738 | TRBC1 | CUUUCCAGAGGACCUGAACA | Chr7: 142791680-142791702 | 5634 |
| CR000739 | TRBC1 | UCAAACACAGCGACCUCGGG | Chr7: 142791708-142791730 | 5635 |
| CR000740 | TRBC1 | UGACGGGUUUGGCCCUAUCC | Chr7: 142792016-142792038 | 5636 |
| CR000741 | TRBC1 | GGCGCUGACGAUCUGGGUGA | Chr7: 142792033-142792055 | 5637 |
| CR000742 | TRBC1 | CGGGUGGGAACACCUUGUUC | Chr7: 142791692-142791714 | 5638 |
| CR000743 | TRBC1 | GAACAAGGUGUUCCCACCCG | Chr7: 142791695-142791717 | 5639 |
| CR000744 | TRBC1 | CAAACACAGCGACCUCGGGU | Chr7: 142791707-142791729 | 5640 |

TABLE 5-continued gRNA targeting domains for human T-Cell Receptor Beta (Constant Domain 1 and Constant Domain 2)

| Id. | Target Name | gRNA Targeting Domain Sequence | Genomic Information | SEQ ID NO: |
|---|---|---|---|---|
| CR000745 | TRBC1 | GGCUCAAACACAGCGACCUC | Chr7: 142791711-142791733 | 5641 |
| CR000746 | TRBC1 | AGCUCAGCUCCACGUGGUCA | Chr7: 142791797-142791819 | 5642 |
| CR000747 | TRBC1 | GACGAUCUGGGUGACGGGUU | Chr7: 142792027-142792049 | 5643 |
| CR000748 | TRBC2 | UAUCAGGCUCCUCUGCUACG | Chr7: 142670776-142670798 | 5644 |
| CR000749 | TRBC2 | AUCAGGCUCCUCUGCUACGU | Chr7: 142670777-142670799 | 5645 |
| CR000750 | TRBC2 | CUACGUGGGCUUUUAUUUUC | Chr7: 142670791-142670813 | 5646 |
| CR000751 | TRBC2 | ACGUGGGCUUUUAUUUUCUG | Chr7: 142670793-142670815 | 5647 |
| CR000752 | TRBC2 | CGUGGGCUUUUAUUUUCUGG | Chr7: 142670794-142670816 | 5648 |
| CR000753 | TRBC2 | AAUAAAAGCCCACGUAGCAG | Chr7: 142670785-142670807 | 5649 |
| CR000754 | TRBC2 | ACCCCAAGAUACCUUGUUAU | Chr7: 142670970-142670992 | 5650 |
| CR000755 | TRBC2 | AGAUACCUUGUUAUAGGGAC | Chr7: 142670976-142670998 | 5651 |
| CR000756 | TRBC2 | GACAGGAAAGAAGAUCACUC | Chr7: 142670993-142671015 | 5652 |
| CR000757 | TRBC2 | UCUGGAAUGUUCUCAAACCA | Chr7: 142671011-142671033 | 5653 |
| CR000758 | TRBC2 | CUGGAAUGUUCUCAAACCAU | Chr7: 142671012-142671034 | 5654 |
| CR000759 | TRBC2 | UACUGGUAUCAACAAGAUCC | Chr7: 142671048-142671070 | 5655 |
| CR000760 | TRBC2 | GUAUCAACAAGAUCCAGGAA | Chr7: 142671053-142671075 | 5656 |
| CR000761 | TRBC2 | CACCUCAUCCACUAUUCCUA | Chr7: 142671081-142671103 | 5657 |
| CR000762 | TRBC2 | GGAGUUAAUUCCACAGAGAA | Chr7: 142671102-142671124 | 5658 |
| CR000763 | TRBC2 | AGUCAACAGUCUCCAGAAUA | Chr7: 142671139-142671161 | 5659 |
| CR000764 | TRBC2 | AACAGUCUCCAGAAUAAGGA | Chr7: 142671143-142671165 | 5660 |
| CR000765 | TRBC2 | CCCUGACCCUGGAGUCUGCC | Chr7: 142671175-142671197 | 5661 |
| CR000766 | TRBC2 | UAACAAGGUAUCUUGGGGUC | Chr7: 142670966-142670988 | 5662 |
| CR000767 | TRBC2 | CCCUAUAACAAGGUAUCUUG | Chr7: 142670971-142670993 | 5663 |
| CR000768 | TRBC2 | UCCCUAUAACAAGGUAUCUU | Chr7: 142670972-142670994 | 5664 |
| CR000769 | TRBC2 | GUCCCUAUAACAAGGUAUCU | Chr7: 142670973-142670995 | 5665 |

TABLE 5-continued gRNA targeting domains for human T-Cell Receptor Beta (Constant Domain 1 and Constant Domain 2)

| Id. | Target Name | gRNA Targeting Domain Sequence | Genomic Information | SEQ ID NO: |
|---|---|---|---|---|
| CR000770 | TRBC2 | UCUUUCCUGUCCCUAUAACA | Chr7: 142670981-142671003 | 5666 |
| CR000771 | TRBC2 | GAUACCAGUACAUUUUGUCA | Chr7: 142671035-142671057 | 5667 |
| CR000772 | TRBC2 | AUGAGGUGUAGUUCCAUUCC | Chr7: 142671066-142671088 | 5668 |
| CR000773 | TRBC2 | CUCCAUAGGAAUAGUGGAUG | Chr7: 142671083-142671105 | 5669 |
| CR000774 | TRBC2 | AAUUAACUCCAUAGGAAUAG | Chr7: 142671089-142671111 | 5670 |
| CR000775 | TRBC2 | CUCUGUGGAAUUAACUCCAU | Chr7: 142671097-142671119 | 5671 |
| CR000776 | TRBC2 | UCUGGAGACUGUUGACUCAG | Chr7: 142671133-142671155 | 5672 |
| CR000777 | TRBC2 | AAAAUGCUCCGUCCUUAUUC | Chr7: 142671151-142671173 | 5673 |
| CR000778 | TRBC2 | CCUGGCAGACUCCAGGGUCA | Chr7: 142671175-142671197 | 5674 |
| CR000779 | TRBC2 | GCCUGGCAGACUCCAGGGUC | Chr7: 142671176-142671198 | 5675 |
| CR000780 | TRBC2 | UGAGGGCCUGGCAGACUCCA | Chr7: 142671181-142671203 | 5676 |
| CR000781 | TRBC2 | GUGAGGGCCUGGCAGACUCC | Chr7: 142671182-142671204 | 5677 |
| CR000782 | TRBC2 | GAGGUACUGAGAGGUAUGUG | Chr7: 142671199-142671221 | 5678 |
| CR000783 | TRBC2 | GCUGGCACAGAGGUACUGAG | Chr7: 142671208-142671230 | 5679 |
| CR000784 | TRBC2 | UGUAUUCACUGCUGGCACAG | Chr7: 142671218-142671240 | 5680 |
| CR000785 | TRBC2 | GAGCUGUCUGGUUCUGGUAG | Chr7: 142791626-142791648 | 5681 |
| CR000786 | TRBC2 | AGAGCUGUCUGGUUCUGGUA | Chr7: 142791627-142791649 | 5682 |
| CR000787 | TRBC2 | GAGAGCUGUCUGGUUCUGGU | Chr7: 142791628-142791650 | 5683 |
| CR000788 | TRBC2 | CUCUGAGAGCUGUCUGGUUC | Chr7: 142791632-142791654 | 5684 |
| CR000789 | TRBC2 | GGGUUGCUCUGAGAGCUGUC | Chr7: 142791638-142791660 | 5685 |
| CR000790 | TRBC2 | GAAAAACGUGUUCCCACCCA | Chr7: 142801042-142801064 | 5686 |
| CR000791 | TRBC2 | AGGCUUCUACCCCGACCACG | Chr7: 142801135-142801157 | 5687 |
| CR000792 | TRBC2 | CCGACCACGUGGAGCUGAGC | Chr7: 142801146-142801168 | 5688 |
| CR000793 | TRBC2 | CACAGACCCGCAGCCCCUCA | Chr7: 142801204-142801226 | 5689 |

TABLE 5-continued gRNA targeting domains for human T-Cell Receptor Beta (Constant Domain 1 and Constant Domain 2)

| Id. | Target Name | gRNA Targeting Domain Sequence | Genomic Information | SEQ ID NO: |
|---|---|---|---|---|
| CR000794 | TRBC2 | UGGGUGGGAACACGUUUUUC | Chr7: 142801039-142801061 | 5690 |
| CR000795 | TRBC2 | CAAACACAGCGACCUUGGGU | Chr7: 142801054-142801076 | 5691 |
| CR000796 | TRBC2 | UCAAACACAGCGACCUUGGG | Chr7: 142801055-142801077 | 5692 |
| CR000797 | TRBC2 | GGCUCAAACACAGCGACCUU | Chr7: 142801058-142801080 | 5693 |
| CR000798 | TRBC2 | UGGCUCAAACACAGCGACCU | Chr7: 142801059-142801081 | 5694 |
| CR000799 | TRBC2 | CGGGGUAGAAGCCUGUGGCC | Chr7: 142801126-142801148 | 5695 |
| CR000800 | TRBC2 | GUGGUCGGGUAGAAGCCUG | Chr7: 142801131-142801153 | 5696 |
| CR000801 | TRBC2 | AGCUCAGCUCCACGUGGUCG | Chr7: 142801144-142801166 | 5697 |
| CR000802 | TRBC2 | CAGCUCAGCUCCACGUGGUC | Chr7: 142801145-142801167 | 5698 |
| CR000803 | TRBC2 | CCAGCUCAGCUCCACGUGGU | Chr7: 142801146-142801168 | 5699 |
| CR000804 | TRBC2 | GACAGGUUUGGCCCUAUCCU | Chr7: 142801362-142801384 | 5700 |
| CR000805 | TRBC2 | UGACAGGUUUGGCCCUAUCC | Chr7: 142801363-142801385 | 5701 |
| CR000806 | TRBC2 | GACGAUCUGGGUGACAGGUU | Chr7: 142801374-142801396 | 5702 |
| CR000807 | TRBC2 | GCGCUGACGAUCUGGGUGAC | Chr7: 142801379-142801401 | 5703 |
| CR000808 | TRBC2 | CCCUGUUUUCUUUCAGACUG | Chr7: 142801922-142801944 | 5704 |
| CR000809 | TRBC2 | AGGAGAGACUCACUUACCGG | Chr7: 142801950-142801972 | 5705 |
| CR000810 | TRBC2 | AAAAGGAGAGACUCACUUAC | Chr7: 142801953-142801975 | 5706 |
| CR000811 | TRBC2 | UCAACAGAGUCUUACCAGCA | Chr7: 142802092-142802114 | 5707 |
| CR000812 | TRBC2 | CAACAGAGUCUUACCAGCAA | Chr7: 142802093-142802115 | 5708 |
| CR000813 | TRBC2 | AACAGAGUCUUACCAGCAAG | Chr7: 142802094-142802116 | 5709 |
| CR000814 | TRBC2 | AUCCUCUAUGAGAUCUUGCU | Chr7: 142802131-142802153 | 5710 |
| CR000815 | TRBC2 | UCCUCUAUGAGAUCUUGCUA | Chr7: 142802132-142802154 | 5711 |
| CR000816 | TRBC2 | CUAUGAGAUCUUGCUAGGGA | Chr7: 142802136-142802158 | 5712 |
| CR000817 | TRBC2 | GGCCACCUUGUAUGCCGUGC | Chr7: 142802157-142802179 | 5713 |
| CR000818 | TRBC2 | GGUCAGUGCCCUCGUGCUGA | Chr7: 142802178-142802200 | 5714 |

TABLE 5-continued gRNA targeting domains for human T-Cell Receptor Beta (Constant Domain 1 and Constant Domain 2)

| Id. | Target Name | gRNA Targeting Domain Sequence | Genomic Information | SEQ ID NO: |
|---|---|---|---|---|
| CR000819 | TRBC2 | UGGCAGACAGGACCCCUUGC | Chr7: 142802106-142802128 | 5715 |
| CR000820 | TRBC2 | CAUAGAGGAUGGUGGCAGAC | Chr7: 142802118-142802140 | 5716 |
| CR000821 | TRBC2 | CAAGAUCUCAUAGAGGAUGG | Chr7: 142802126-142802148 | 5717 |
| CR000822 | TRBC2 | UAGCAAGAUCUCAUAGAGGA | Chr7: 142802129-142802151 | 5718 |
| CR000823 | TRBC2 | UCCCUAGCAAGAUCUCAUAG | Chr7: 142802133-142802155 | 5719 |

In the various aspects of the invention, the gRNA molecule may include a targeting domain listed above. In an embodiment, the targeting domain of the gRNA of the invention comprises, e.g. consists of, the targeting domain of CR000823. In an embodiment, the targeting domain of the gRNA of the invention comprises, e.g. consists of, the targeting domain of CR000798. In an embodiment, the targeting domain of the gRNA of the invention comprises, e.g. consists of, the targeting domain of CR000810. In an embodiment, the targeting domain of the gRNA of the invention comprises, e.g. consists of, the targeting domain of CR000800. In an embodiment, the targeting domain of the gRNA of the invention comprises, e.g. consists of, the targeting domain of CR000815. In an embodiment, the targeting domain of the gRNA of the invention comprises, e.g. consists of, the targeting domain of CR000812. In an embodiment, the targeting domain of the gRNA of the invention comprises, e.g. consists of, the targeting domain of CR000813. In an embodiment, the targeting domain of the gRNA of the invention comprises, e.g. consists of, the targeting domain of CR000816. In an embodiment, the targeting domain of the gRNA of the invention comprises, e.g. consists of, the targeting domain of CR000807. In an embodiment, the targeting domain of the gRNA of the invention comprises, e.g. consists of, the targeting domain of CR000811. In an embodiment, the targeting domain of the gRNA of the invention comprises, e.g. consists of, the targeting domain of CR000791. In an embodiment, the targeting domain of the gRNA of the invention comprises, e.g. consists of, the targeting domain of CR000809. In an embodiment, the targeting domain of the gRNA of the invention comprises, e.g. consists of, the targeting domain of CR000817. In an embodiment, the targeting domain of the gRNA of the invention comprises, e.g. consists of, the targeting domain of CR000819. In an embodiment, the targeting domain of the gRNA of the invention comprises, e.g. consists of, the targeting domain of CR000814. Such gRNA molecules, and combinations thereof, are suitable for use in, for example, the CRISPR systems, methods and cells and other aspects of the invention described herein.

TABLE 6 gRNA Targeting Domains for human PDCD1

| Id. | Target Name | gRNA Targeting Domain Sequence | Genomic Information | SEQ ID NO: |
|---|---|---|---|---|
| CR000824 | PDCD1 | UCAGGCGGAGGUGAGCGGAA | Chr2: 241858873-241858895 | 5720 |
| CR000825 | PDCD1 | CUCAGGCGGAGGUGAGCGGA | Chr2: 241858872-241858894 | 5721 |
| CR000826 | PDCD1 | ACUGCUCAGGCGGAGGUGAG | Chr2: 241858868-241858890 | 5722 |
| CR000827 | PDCD1 | GCUCACCUCCGCCUGAGCAG | Chr2: 241858866-241858888 | 5723 |
| CR000828 | PDCD1 | CUUCUCCACUGCUCAGGCGG | Chr2: 241858861-241858883 | 5724 |
| CR000829 | PDCD1 | CAGUGGAGAAGGCGGCACUC | Chr2: 241858849-241858871 | 5725 |
| CR000830 | PDCD1 | UGGAGAAGGCGGCACUCUGG | Chr2: 241858846-241858868 | 5726 |
| CR000831 | PDCD1 | GGAGAAGGCGGCACUCUGGU | Chr2: 241858845-241858867 | 5727 |

TABLE 6-continued gRNA Targeting Domains for human PDCD1

| Id. | Target Name | gRNA Targeting Domain Sequence | Genomic Information | SEQ ID NO: |
|---|---|---|---|---|
| CR000832 | PDCD1 | GAGAAGGCGGCACUCUGGUG | Chr2: 241858844-241858866 | 5728 |
| CR000833 | PDCD1 | AGGCGCCCUGGCCAGUCGUC | Chr2: 241858797-241858819 | 5729 |
| CR000834 | PDCD1 | GGCGCCCUGGCCAGUCGUCU | Chr2: 241858796-241858818 | 5730 |
| CR000835 | PDCD1 | GCCCUGGCCAGUCGUCUGGG | Chr2: 241858793-241858815 | 5731 |
| CR000836 | PDCD1 | CACCGCCCAGACGACUGGCC | Chr2: 241858791-241858813 | 5732 |
| CR000837 | PDCD1 | UGUAGCACCGCCCAGACGAC | Chr2: 241858786-241858808 | 5733 |
| CR000838 | PDCD1 | CGUCUGGGCGGUGCUACAAC | Chr2: 241858781-241858803 | 5734 |
| CR000839 | PDCD1 | GUCUGGGCGGUGCUACAACU | Chr2: 241858780-241858802 | 5735 |
| CR000840 | PDCD1 | GGGCGGUGCUACAACUGGGC | Chr2: 241858776-241858798 | 5736 |
| CR000841 | PDCD1 | CGGUGCUACAACUGGGCUGG | Chr2: 241858773-241858795 | 5737 |
| CR000842 | PDCD1 | CACCUACCUAAGAACCAUCC | Chr2: 241858750-241858772 | 5738 |
| CR000843 | PDCD1 | GAGAAGGUGGGGGGGUUCCA | Chr2: 241852938-241852960 | 5739 |
| CR000844 | PDCD1 | CGGUCACCACGAGCAGGGCU | Chr2: 241852915-241852937 | 5740 |
| CR000845 | PDCD1 | UCGGUCACCACGAGCAGGGC | Chr2: 241852914-241852936 | 5741 |
| CR000846 | PDCD1 | GCCCUGCUCGUGGUGACCGA | Chr2: 241852911-241852933 | 5742 |
| CR000847 | PDCD1 | CCCUUCGGUCACCACGAGCA | Chr2: 241852910-241852932 | 5743 |
| CR000848 | PDCD1 | CCCUGCUCGUGGUGACCGAA | Chr2: 241852910-241852932 | 5744 |
| CR000849 | PDCD1 | CCCCUUCGGUCACCACGAGC | Chr2: 241852909-241852931 | 5745 |
| CR000850 | PDCD1 | CCUGCUCGUGGUGACCGAAG | Chr2: 241852909-241852931 | 5746 |
| CR000851 | PDCD1 | GAAGGUGGCGUUGUCCCCUU | Chr2: 241852895-241852917 | 5747 |
| CR000852 | PDCD1 | GUUGGAGAAGCUGCAGGUGA | Chr2: 241852877-241852899 | 5748 |
| CR000853 | PDCD1 | CACGAAGCUCUCCGAUGUGU | Chr2: 241852859-241852881 | 5749 |
| CR000854 | PDCD1 | CGGAGAGCUUCGUGCUAAAC | Chr2: 241852850-241852872 | 5750 |

TABLE 6-continued gRNA Targeting Domains for human PDCD1

| Id. | Target Name | gRNA Targeting Domain Sequence | Genomic Information | SEQ ID NO: |
|---|---|---|---|---|
| CR000855 | PDCD1 | UCUGGUUGCUGGGGCUCAUG | Chr2: 241852825-241852847 | 5751 |
| CR000856 | PDCD1 | GCUUGUCCGUCUGGUUGCUG | Chr2: 241852816-241852838 | 5752 |
| CR000857 | PDCD1 | AGCUUGUCCGUCUGGUUGCU | Chr2: 241852815-241852837 | 5753 |
| CR000858 | PDCD1 | CAGCUUGUCCGUCUGGUUGC | Chr2: 241852814-241852836 | 5754 |
| CR000859 | PDCD1 | CAGCAACCAGACGGACAAGC | Chr2: 241852813-241852835 | 5755 |
| CR000860 | PDCD1 | AGGCGGCCAGCUUGUCCGUC | Chr2: 241852807-241852829 | 5756 |
| CR000861 | PDCD1 | CUGGCUGCGGUCCUCGGGGA | Chr2: 241852787-241852809 | 5757 |
| CR000862 | PDCD1 | CGGGCUGGCUGCGGUCCUCG | Chr2: 241852783-241852805 | 5758 |
| CR000863 | PDCD1 | CCGGGCUGGCUGCGGUCCUC | Chr2: 241852782-241852804 | 5759 |
| CR000864 | PDCD1 | CCCGAGGACCGCAGCCAGCC | Chr2: 241852782-241852804 | 5760 |
| CR000865 | PDCD1 | GCCGGGCUGGCUGCGGUCCU | Chr2: 241852781-241852803 | 5761 |
| CR000866 | PDCD1 | CGGAAGCGGCAGUCCUGGCC | Chr2: 241852764-241852786 | 5762 |
| CR000867 | PDCD1 | ACGGAAGCGGCAGUCCUGGC | Chr2: 241852763-241852785 | 5763 |
| CR000868 | PDCD1 | UGACACGGAAGCGGCAGUCC | Chr2: 241852759-241852781 | 5764 |
| CR000869 | PDCD1 | GCAGUUGUGUGACACGGAAG | Chr2: 241852750-241852772 | 5765 |
| CR000870 | PDCD1 | CGUGUCACACAACUGCCCAA | Chr2: 241852743-241852765 | 5766 |
| CR000871 | PDCD1 | GUGUCACACAACUGCCCAAC | Chr2: 241852742-241852764 | 5767 |
| CR000872 | PDCD1 | AUGUGGAAGUCACGCCCGUU | Chr2: 241852728-241852750 | 5768 |
| CR000873 | PDCD1 | CAUGUGGAAGUCACGCCCGU | Chr2: 241852727-241852749 | 5769 |
| CR000874 | PDCD1 | GCGUGACUUCCACAUGAGCG | Chr2: 241852720-241852742 | 5770 |
| CR000875 | PDCD1 | ACUUCCACAUGAGCGUGGUC | Chr2: 241852715-241852737 | 5771 |
| CR000876 | PDCD1 | CUUCCACAUGAGCGUGGUCA | Chr2: 241852714-241852736 | 5772 |

TABLE 6-continued gRNA Targeting Domains for human PDCD1

| Id. | Target Name | gRNA Targeting Domain Sequence | Genomic Information | SEQ ID NO: |
|---|---|---|---|---|
| CR000877 | PDCD1 | GGGCCCUGACCACGCUCAUG | Chr2: 241852711-241852733 | 5773 |
| CR000878 | PDCD1 | ACAUGAGCGUGGUCAGGGCC | Chr2: 241852709-241852731 | 5774 |
| CR000879 | PDCD1 | AGGGCCCGGCGCAAUGACAG | Chr2: 241852695-241852717 | 5775 |
| CR000880 | PDCD1 | GGUGCCGCUGUCAUUGCGCC | Chr2: 241852691-241852713 | 5776 |
| CR000881 | PDCD1 | AGGUGCCGCUGUCAUUGCGC | Chr2: 241852690-241852712 | 5777 |
| CR000882 | PDCD1 | GACAGCGGCACCUACCUCUG | Chr2: 241852680-241852702 | 5778 |
| CR000883 | PDCD1 | ACAGCGGCACCUACCUCUGU | Chr2: 241852679-241852701 | 5779 |
| CR000884 | PDCD1 | CCAGGGAGAUGGCCCCACAG | Chr2: 241852666-241852688 | 5780 |
| CR000885 | PDCD1 | GAUCUGCGCCUUGGGGCCA | Chr2: 241852649-241852671 | 5781 |
| CR000886 | PDCD1 | UGAUCUGCGCCUUGGGGCC | Chr2: 241852648-241852670 | 5782 |
| CR000887 | PDCD1 | CUCUUUGAUCUGCGCCUUGG | Chr2: 241852643-241852665 | 5783 |
| CR000888 | PDCD1 | UCUCUUUGAUCUGCGCCUUG | Chr2: 241852642-241852664 | 5784 |
| CR000889 | PDCD1 | CUCUCUUUGAUCUGCGCCUU | Chr2: 241852641-241852663 | 5785 |
| CR000890 | PDCD1 | GCUCUCUUUGAUCUGCGCCU | Chr2: 241852640-241852662 | 5786 |
| CR000891 | PDCD1 | CGCAGAUCAAAGAGAGCCUG | Chr2: 241852634-241852656 | 5787 |
| CR000892 | PDCD1 | GCAGAUCAAAGAGAGCCUGC | Chr2: 241852633-241852655 | 5788 |
| CR000893 | PDCD1 | AGAGCCUGCGGGCAGAGCUC | Chr2: 241852622-241852644 | 5789 |
| CR000894 | PDCD1 | AGGGUUUGGAACUGGCCGGC | Chr2: 241852278-241852300 | 5790 |
| CR000895 | PDCD1 | CACCAGGGUUUGGAACUGGC | Chr2: 241852274-241852296 | 5791 |
| CR000896 | PDCD1 | CGGCCAGUUCCAAACCCUGG | Chr2: 241852273-241852295 | 5792 |
| CR000897 | PDCD1 | CAACCACCAGGGUUUGGAAC | Chr2: 241852270-241852292 | 5793 |
| CR000898 | PDCD1 | CAGUUCCAAACCCUGGUGGU | Chr2: 241852269-241852291 | 5794 |
| CR000899 | PDCD1 | CGACACCAACCACCAGGGUU | Chr2: 241852264-241852286 | 5795 |
| CR000900 | PDCD1 | AACCCUGGUGGUUGGUGUCG | Chr2: 241852261-241852283 | 5796 |
| CR000901 | PDCD1 | ACCCUGGUGGUUGGUGUCGU | Chr2: 241852260-241852282 | 5797 |

TABLE 6-continued gRNA Targeting Domains for human PDCD1

| Id. | Target Name | gRNA Targeting Domain Sequence | Genomic Information | SEQ ID NO: |
|---|---|---|---|---|
| CR000902 | PDCD1 | GCCCACGACACCAACCACCA | Chr2: 241852259-241852281 | 5798 |
| CR000903 | PDCD1 | CGCCCACGACACCAACCACC | Chr2: 241852258-241852280 | 5799 |
| CR000904 | PDCD1 | CUGGUGGUUGGUGUCGUGGG | Chr2: 241852257-241852279 | 5800 |
| CR000905 | PDCD1 | UGGUGUCGUGGGCGGCCUGC | Chr2: 241852249-241852271 | 5801 |
| CR000906 | PDCD1 | GGUGUCGUGGGCGGCCUGCU | Chr2: 241852248-241852270 | 5802 |
| CR000907 | PDCD1 | GGUGCUGCUAGUCUGGGUCC | Chr2: 241852219-241852241 | 5803 |
| CR000908 | PDCD1 | UCCUGGCCGUCAUCUGCUCC | Chr2: 241852202-241852224 | 5804 |
| CR000909 | PDCD1 | CCCGGGAGCAGAUGACGGCC | Chr2: 241852201-241852223 | 5805 |
| CR000910 | PDCD1 | CCUGGCCGUCAUCUGCUCCC | Chr2: 241852201-241852223 | 5806 |
| CR000911 | PDCD1 | GACGUUACCUCGUGCGGCCC | Chr2: 241852184-241852206 | 5807 |
| CR000912 | PDCD1 | UGACGUUACCUCGUGCGGCC | Chr2: 241852183-241852205 | 5808 |
| CR000913 | PDCD1 | UGGGAUGACGUUACCUCGUG | Chr2: 241852178-241852200 | 5809 |
| CR000914 | PDCD1 | CUGCAGGGACAAUAGGAGCC | Chr2: 241851961-241851983 | 5810 |
| CR000915 | PDCD1 | ACAAUAGGAGCCAGGCGCAC | Chr2: 241851953-241851975 | 5811 |
| CR000916 | PDCD1 | CAGGGGCUGGCCGGUGCGCC | Chr2: 241851943-241851965 | 5812 |
| CR000917 | PDCD1 | AAAAGAGUGAGACUCACCAG | Chr2: 241851926-241851948 | 5813 |
| CR000918 | PDCD1 | GAAAAGAGUGAGACUCACCA | Chr2: 241851925-241851947 | 5814 |
| CR000919 | PDCD1 | GGAAAAGAGUGAGACUCACC | Chr2: 241851924-241851946 | 5815 |

In the various aspects of the invention, the gRNA molecule may include a targeting domain listed above. In an embodiment, the targeting domain of the gRNA of the invention comprises, e.g. consists of, the targeting domain of CR000847. In an embodiment, the targeting domain of the gRNA of the invention comprises, e.g. consists of, the targeting domain of CR000902. In an embodiment, the targeting domain of the gRNA of the invention comprises, e.g. consists of, the targeting domain of CR000852. In an embodiment, the targeting domain of the gRNA of the invention comprises, e.g. consists of, the targeting domain of CR000826. In an embodiment, the targeting domain of the gRNA of the invention comprises, e.g. consists of, the targeting domain of CR000904. In an embodiment, the targeting domain of the gRNA of the invention comprises, e.g. consists of, the targeting domain of CR000839. In an embodiment, the targeting domain of the gRNA of the invention comprises, e.g. consists of, the targeting domain of CR000828. In an embodiment, the targeting domain of the gRNA of the invention comprises, e.g. consists of, the targeting domain of CR000835. In an embodiment, the targeting domain of the gRNA of the invention comprises, e.g. consists of, the targeting domain of CR000829. In an embodiment, the targeting domain of the gRNA of the invention comprises, e.g. consists of, the targeting domain of CR000879. In an embodiment, the targeting domain of the gRNA of the invention comprises, e.g. consists of, the targeting domain of CR000870. In an embodiment, the targeting domain of the gRNA of the invention comprises, e.g. consists of, the targeting domain of CR000831. In an embodiment, the targeting domain of the gRNA of the invention comprises, e.g. consists of, the targeting domain of CR000848. In an embodiment, the targeting domain of the gRNA of the invention comprises, e.g. consists of, the targeting domain of CR000855. In an embodiment, the targeting domain of the gRNA of the invention comprises, e.g. consists of, the targeting domain of CR000838. Such gRNA molecules, and combinations thereof, are suitable for use in, for example, the CRISPR systems, methods and cells, and other aspects of the invention described herein.

TABLE 6b gRNA Targeting Domains for human FKBP1A

| ID | Target | Strand | Target Sequence Location | gRNA Targeting Domain Sequence | SEQ ID NO: |
|---|---|---|---|---|---|
| CR002054 | FKBP1A | - | Chr20: 1393120-1393142 | CGCACGCAGGGCUGGGCGUG | 6662 |
| CR002055 | FKBP1A | - | Chr20: 1393119-1393141 | GCACGCAGGGCUGGGCGUGA | 6663 |
| CR002056 | FKBP1A | - | Chr20: 1393118-1393140 | CACGCAGGGCUGGGCGUGAG | 6664 |
| CR002057 | FKBP1A | - | Chr20: 1393117-1393139 | ACGCAGGGCUGGGCGUGAGG | 6665 |
| CR002058 | FKBP1A | - | Chr20: 1393101-1393123 | GAGGGGGCGUGCGCGUGCGC | 6666 |
| CR002059 | FKBP1A | - | Chr20: 1393088-1393110 | CGUGCGCAGGCGACGCGCCG | 6667 |
| CR002060 | FKBP1A | - | Chr20: 1393081-1393103 | AGGCGACGCGCCGAGGUACU | 6668 |
| CR002061 | FKBP1A | + | Chr20: 1393071-1393093 | CACGGCUCUGCCUAGUACCU | 6669 |
| CR002062 | FKBP1A | - | Chr20: 1393070-1393092 | CGAGGUACUAGGCAGAGCCG | 6670 |
| CR002063 | FKBP1A | - | Chr20: 1393057-1393079 | AGAGCCGUGGAACCGCCGCC | 6671 |
| CR002064 | FKBP1A | + | Chr20: 1393053-1393075 | GCGACCUGGCGGCGGUUCCA | 6672 |
| CR002065 | FKBP1A | - | Chr20: 1393047-1393069 | AACCGCCGCCAGGUCGCUGU | 6673 |
| CR002066 | FKBP1A | + | Chr20: 1393045-1393067 | GACCAACAGCGACCUGGCGG | 6674 |
| CR002067 | FKBP1A | + | Chr20: 1393042-1393064 | GUGGACCAACAGCGACCUGG | 6675 |
| CR002068 | FKBP1A | + | Chr20: 1393039-1393061 | GGCGUGGACCAACAGCGACC | 6676 |
| CR002069 | FKBP1A | + | Chr20: 1393023-1393045 | GGGCGGCGCGACGGGCGCG | 6677 |
| CR002070 | FKBP1A | + | Chr20: 1393018-1393040 | CGGGCGGCGGCGCGACGGG | 6678 |
| CR002071 | FKBP1A | + | Chr20: 1393015-1393037 | GAGCGGGCGGGCGGCGCGAC | 6679 |
| CR002072 | FKBP1A | + | Chr20: 1393014-1393036 | UGAGCGGGCGGGCGGCGCGA | 6680 |
| CR002073 | FKBP1A | + | Chr20: 1393006-1393028 | GCGGACGCUGAGCGGGCGGG | 6681 |
| CR002074 | FKBP1A | + | Chr20: 1393003-1393025 | GCGGCGGACGCUGAGCGGGC | 6682 |
| CR002075 | FKBP1A | + | Chr20: 1393002-1393024 | GGCGGCGGACGCUGAGCGGG | 6683 |
| CR002076 | FKBP1A | + | Chr20: 1392999-1393021 | GGCGGCGGCGGACGCUGAGC | 6684 |

TABLE 6b-continued gRNA Targeting Domains for human FKBP1A

| ID | Target | Strand | Target Sequence Location | gRNA Targeting Domain Sequence | SEQ ID NO: |
|---|---|---|---|---|---|
| CR002077 | FKBP1A | + | Chr20: 1392998-1393020 | UGGCGGCGGCGGACGCUGAG | 6685 |
| CR002078 | FKBP1A | - | Chr20: 1392995-1393017 | CUCAGCGUCCGCCGCCGCCA | 6686 |
| CR002079 | FKBP1A | - | Chr20: 1392994-1393016 | UCAGCGUCCGCCGCCGCCAU | 6687 |
| CR002080 | FKBP1A | + | Chr20: 1392987-1393009 | CUGCACUCCCAUGGCGGCGG | 6688 |
| CR002081 | FKBP1A | - | Chr20: 1392986-1393008 | CGCCGCCGCCAUGGGAGUGC | 6689 |
| CR002082 | FKBP1A | + | Chr20: 1392984-1393006 | CACCUGCACUCCCAUGGCGG | 6690 |
| CR002083 | FKBP1A | - | Chr20: 1392983-1393005 | CGCCGCCAUGGGAGUGCAGG | 6691 |
| CR002084 | FKBP1A | + | Chr20: 1392981-1393003 | UUCCACCUGCACUCCCAUGG | 6692 |
| CR002085 | FKBP1A | + | Chr20: 1392978-1393000 | GGUUUCCACCUGCACUCCCA | 6693 |
| CR002086 | FKBP1A | - | Chr20: 1392967-1392989 | CAGGUGGAAACCAUCUCCCC | 6694 |
| CR002087 | FKBP1A | + | Chr20: 1392957-1392979 | CUCACCGUCUCCUGGGGAGA | 6695 |
| CR002088 | FKBP1A | + | Chr20: 1392951-1392973 | CCACUACUCACCGUCUCUG | 6696 |
| CR002089 | FKBP1A | + | Chr20: 1392950-1392972 | GCCACUACUCACCGUCUCCU | 6697 |
| CR002090 | FKBP1A | + | Chr20: 1392949-1392971 | CGCCACUACUCACCGUCUCC | 6698 |
| CR002091 | FKBP1A | - | Chr20: 1392880-1392902 | UGCCCGUCUCUGUCUCCUCA | 6699 |
| CR002092 | FKBP1A | - | Chr20: 1392860-1392882 | GGGCGCACCUUCCCAAGCG | 6700 |
| CR002093 | FKBP1A | + | Chr20: 1392853-1392875 | GGUCUGGCCGCGCUUGGGGA | 6701 |
| CR002094 | FKBP1A | + | Chr20: 1392849-1392871 | CGCAGGUCUGGCCGCGCUUG | 6702 |
| CR002095 | FKBP1A | + | Chr20: 1392848-1392870 | ACGCAGGUCUGGCCGCGCUU | 6703 |
| CR002096 | FKBP1A | + | Chr20: 1392847-1392869 | CACGCAGGUCUGGCCGCGCU | 6704 |
| CR002097 | FKBP1A | - | Chr20: 1392846-1392868 | CAAGCGCGGCCAGACCUGCG | 6705 |
| CR002098 | FKBP1A | + | Chr20: 1392837-1392859 | UGUAGUGCACCACGCAGGUC | 6706 |
| CR002099 | FKBP1A | + | Chr20: 1392832-1392854 | ACCGGUGUAGUGCACCACGC | 6707 |
| CR002100 | FKBP1A | + | Chr20: 1392814-1392836 | CCGCUGGGCCCCCGACUCAC | 6708 |
| CR002101 | FKBP1A | - | Chr20: 1375602-1375624 | UUACAGUCGUCUUUUUCACA | 6709 |

TABLE 6b-continued gRNA Targeting Domains for human FKBP1A

| ID | Target | Strand | Target Sequence Location | gRNA Targeting Domain Sequence | SEQ ID NO: |
|---|---|---|---|---|---|
| CR002102 | FKBP1A | - | Chr20: 1375588-1375610 | UUCACAGGGAUGCUUGAAGA | 6710 |
| CR002103 | FKBP1A | - | Chr20: 1375566-1375588 | GAAAGAAAUUUGAUUCCUCC | 6711 |
| CR002104 | FKBP1A | - | Chr20: 1375565-1375587 | AAAGAAAUUUGAUUCCUCCC | 6712 |
| CR002105 | FKBP1A | + | Chr20: 1375551-1375573 | GGGCUUGUUUCUGUCCCGGG | 6713 |
| CR002106 | FKBP1A | + | Chr20: 1375548-1375570 | AAAGGGCUUGUUUCUGUCCC | 6714 |
| CR002107 | FKBP1A | + | Chr20: 1375547-1375569 | UAAAGGGCUUGUUUCUGUCC | 6715 |
| CR002108 | FKBP1A | - | Chr20: 1375534-1375556 | AAGCCCUUUAAGUUUAUGCU | 6716 |
| CR002109 | FKBP1A | + | Chr20: 1375531-1375553 | UUGCCUAGCAUAAACUUAAA | 6717 |
| CR002110 | FKBP1A | + | Chr20: 1375530-1375552 | CUUGCCUAGCAUAAACUUAA | 6718 |
| CR002111 | FKBP1A | - | Chr20: 1375526-1375548 | UAAGUUUAUGCUAGGCAAGC | 6719 |
| CR002112 | FKBP1A | - | Chr20: 1375523-1375545 | GUUUAUGCUAGGCAAGCAGG | 6720 |
| CR002113 | FKBP1A | - | Chr20: 1375513-1375535 | GGCAAGCAGGAGGUGAUCCG | 6721 |
| CR002114 | FKBP1A | - | Chr20: 1375509-1375531 | AGCAGGAGGUGAUCCGAGGC | 6722 |
| CR002115 | FKBP1A | - | Chr20: 1375508-1375530 | GCAGGAGGUGAUCCGAGGCU | 6723 |
| CR002116 | FKBP1A | - | Chr20: 1375501-1375523 | GUGAUCCGAGGCUGGGAAGA | 6724 |
| CR002117 | FKBP1A | - | Chr20: 1375500-1375522 | UGAUCCGAGGCUGGGAAGAA | 6725 |
| CR002118 | FKBP1A | - | Chr20: 1375499-1375521 | GAUCCGAGGCUGGGAAGAAG | 6726 |
| CR002119 | FKBP1A | + | Chr20: 1375496-1375518 | CAACCCCUUCUUCCCAGCCU | 6727 |
| CR002120 | FKBP1A | + | Chr20: 1375473-1375495 | ACAAAUGAGAGAGCAUACCU | 6728 |
| CR002121 | FKBP1A | + | Chr20: 1375472-1375494 | AACAAAUGAGAGAGCAUACC | 6729 |
| CR002122 | FKBP1A | - | Chr20: 1372231-1372253 | GUUCUUUUCACAGAUGAGUG | 6730 |
| CR002123 | FKBP1A | - | Chr20: 1372230-1372252 | UUCUUUUCACAGAUGAGUGU | 6731 |
| CR002124 | FKBP1A | + | Chr20: 1372199-1372221 | AUCUGGAGAUAUAGUCAGUU | 6732 |
| CR002125 | FKBP1A | - | Chr20: 1372188-1372210 | AUAUCUCCAGAUUAUGCCUA | 6733 |
| CR002126 | FKBP1A | + | Chr20: 1372182-1372204 | GUGGCACCAUAGGCAUAAUC | 6734 |

TABLE 6b-continued gRNA Targeting Domains for human FKBP1A

| ID | Target | Strand | Target Sequence Location | gRNA Targeting Domain Sequence | SEQ ID NO: |
|---|---|---|---|---|---|
| CR002127 | FKBP1A | - | Chr20: 1372179-1372201 | GAUUAUGCCUAUGGUGCCAC | 6735 |
| CR002128 | FKBP1A | - | Chr20: 1372178-1372200 | AUUAUGCCUAUGGUGCCACU | 6736 |
| CR002129 | FKBP1A | + | Chr20: 1372172-1372194 | UGGGUGCCCAGUGGCACCAU | 6737 |
| CR002130 | FKBP1A | - | Chr20: 1372170-1372192 | UAUGGUGCCACUGGGCACCC | 6738 |
| CR002131 | FKBP1A | + | Chr20: 1372163-1372185 | GAUGAUGCCUGGGUGCCCAG | 6739 |
| CR002132 | FKBP1A | + | Chr20: 1372153-1372175 | CAUGUGGUGGGAUGAUGCCU | 6740 |
| CR002133 | FKBP1A | + | Chr20: 1372152-1372174 | GCAUGUGGUGGGAUGAUGCC | 6741 |
| CR002134 | FKBP1A | + | Chr20: 1372141-1372163 | AGACGAGAGUGGCAUGUGGU | 6742 |
| CR002135 | FKBP1A | + | Chr20: 1372140-1372162 | AAGACGAGAGUGGCAUGUGG | 6743 |
| CR002136 | FKBP1A | + | Chr20: 1372137-1372159 | UCGAAGACGAGAGUGGCAUG | 6744 |
| CR002137 | FKBP1A | - | Chr20: 1372132-1372154 | UGCCACUCUCGUCUUCGAUG | 6745 |
| CR002138 | FKBP1A | + | Chr20: 1372130-1372152 | CUCCACAUCGAAGACGAGAG | 6746 |
| CR002139 | FKBP1A | - | Chr20: 1372117-1372139 | CGAUGUGGAGCUUCUAAAAC | 6747 |
| CR002140 | FKBP1A | - | Chr20: 1372108-1372130 | GCUUCUAAAACUGGAAUGAC | 6748 |
| CR002141 | FKBP1A | - | Chr20: 1372103-1372125 | UAAAACUGGAAUGACAGGAA | 6749 |

In the various aspects of the invention, the gRNA molecule may include a targeting domain listed above. In an embodiment, the targeting domain of the gRNA of the invention comprises, e.g. consists of, the targeting domain of CR002100. In an embodiment, the targeting domain of the gRNA of the invention comprises, e.g. consists of, the targeting domain of CR002097. In an embodiment, the targeting domain of the gRNA of the invention comprises, e.g. consists of, the targeting domain of CR002091. In an embodiment, the targeting domain of the gRNA of the invention comprises, e.g. consists of, the targeting domain of CR002085. In an embodiment, the targeting domain of the gRNA of the invention comprises, e.g. consists of, the targeting domain of CR002086. In an embodiment, the targeting domain of the gRNA of the invention comprises, e.g. consists of, the targeting domain of CR002089. In an embodiment, the targeting domain of the gRNA of the invention comprises, e.g. consists of, the targeting domain of CR002088. In an embodiment, the targeting domain of the gRNA of the invention comprises, e.g. consists of, the targeting domain of CR002095. In an embodiment, the targeting domain of the gRNA of the invention comprises, e.g. consists of, the targeting domain of CR002096. In an embodiment, the targeting domain of the gRNA of the invention comprises, e.g. consists of, the targeting domain of CR002080. In an embodiment, the targeting domain of the gRNA of the invention comprises, e.g. consists of, the targeting domain of CR002109. In an embodiment, the targeting domain of the gRNA of the invention comprises, e.g. consists of, the targeting domain of CR002112. In an embodiment, the targeting domain of the gRNA of the invention comprises, e.g. consists of, the targeting domain of CR002110. In an embodiment, the targeting domain of the gRNA of the invention comprises, e.g. consists of, the targeting domain of CR002108. In an embodiment, the targeting domain of the gRNA of the invention comprises, e.g. consists of, the targeting domain of CR002104. In an embodiment, the targeting domain of the gRNA of the invention comprises, e.g. consists of, the targeting domain of CR002115. In an embodiment, the targeting domain of the gRNA of the invention comprises, e.g. consists of, the targeting domain of CR002116. In an embodiment, the targeting domain of the gRNA of the invention comprises, e.g. consists of, the targeting domain of CR002087. In an embodiment, the targeting domain of the gRNA of the invention comprises, e.g. consists of, the targeting domain of CR002107. In an embodiment, the targeting domain of the gRNA of the invention comprises, e.g. consists of, the targeting domain of CR002113. Such gRNA molecules, including combinations thereof, are suitable for use in, for example, the CRISPR systems, methods and cells and other aspects of the invention described herein.

TABLE 6c gRNA Targeting Domains for human CIITA

| Id | Target | Strand | Chromosomal location | gRNA targeting domain sequence | SEQ ID NO: |
|---|---|---|---|---|---|
| CR002939 | CIITA | + | Chr16: 10877252-10877274 | GGCAUCCUUGGGGAAGCUGA | 7717 |
| CR002940 | CIITA | - | Chr16: 10877257-10877279 | UCGUGCCCUCAGCUUCCCCA | 7718 |
| CR002941 | CIITA | + | Chr16: 10877259-10877281 | UUGGGGAAGCUGAGGGCACG | 7719 |
| CR002942 | CIITA | + | Chr16: 10877262-10877284 | GGGAAGCUGAGGGCACGAGG | 7720 |
| CR002943 | CIITA | + | Chr16: 10877263-10877285 | GGAAGCUGAGGGCACGAGGA | 7721 |
| CR002944 | CIITA | + | Chr16: 10877264-10877286 | GAAGCUGAGGGCACGAGGAG | 7722 |
| CR002945 | CIITA | + | Chr16: 10877278-10877300 | GAGGAGGGGCUGCCAGACUC | 7723 |
| CR002946 | CIITA | + | Chr16: 10877279-10877301 | AGGAGGGGCUGCCAGACUCC | 7724 |
| CR002947 | CIITA | - | Chr16: 10877290-10877312 | AGGCAGCAGCUCCCGGAGUC | 7725 |
| CR002948 | CIITA | + | Chr16: 10877292-10877314 | AGACUCCGGGAGCUGCUGCC | 7726 |
| CR002949 | CIITA | + | Chr16: 10877296-10877318 | UCCGGGAGCUGCUGCCUGGC | 7727 |
| CR002950 | CIITA | + | Chr16: 10877297-10877319 | CCGGGAGCUGCUGCCUGGCU | 7728 |
| CR002951 | CIITA | - | Chr16: 10877297-10877319 | CCCAGCCAGGCAGCAGCUCC | 7729 |
| CR002952 | CIITA | - | Chr16: 10877310-10877332 | AUUGUGUAGGAAUCCCAGCC | 7730 |
| CR002953 | CIITA | + | Chr16: 10877321-10877343 | UUCCUACACAAUGCGUUGCC | 7731 |
| CR002954 | CIITA | - | Chr16: 10877323-10877345 | AGCCAGGCAACGCAUUGUGU | 7732 |
| CR002955 | CIITA | + | Chr16: 10877337-10877359 | UGCCUGGCUCCACGCCCUGC | 7733 |
| CR002956 | CIITA | + | Chr16: 10877338-10877360 | GCCUGGCUCCACGCCCUGCU | 7734 |
| CR002957 | CIITA | - | Chr16: 10877339-10877361 | ACCCAGCAGGGCGUGGAGCC | 7735 |
| CR002958 | CIITA | - | Chr16: 10877346-10877368 | AGGUAGGACCCAGCAGGGCG | 7736 |
| CR002959 | CIITA | - | Chr16: 10877351-10877373 | CUGACAGGUAGGACCCAGCA | 7737 |
| CR002960 | CIITA | - | Chr16: 10877352-10877374 | UCUGACAGGUAGGACCCAGC | 7738 |
| CR002961 | CIITA | + | Chr16: 10895283-10895305 | CAGCUCACAGUGUGCCACCA | 7739 |

TABLE 6c-continued gRNA Targeting Domains for human CIITA

| Id | Target | Strand | Chromosomal location | gRNA targeting domain sequence | SEQ ID NO: |
|---|---|---|---|---|---|
| CR002962 | CIITA | + | Chr16: 10895289-10895311 | ACAGUGUGCCACCAUGGAGU | 7740 |
| CR002963 | CIITA | + | Chr16: 10895290-10895312 | CAGUGUGCCACCAUGGAGUU | 7741 |
| CR002964 | CIITA | + | Chr16: 10895291-10895313 | AGUGUGCCACCAUGGAGUUG | 7742 |
| CR002965 | CIITA | - | Chr16: 10895297-10895319 | UAGGGGCCCCAACUCCAUGG | 7743 |
| CR002966 | CIITA | - | Chr16: 10895300-10895322 | UUCUAGGGGCCCCAACUCCA | 7744 |
| CR002967 | CIITA | + | Chr16: 10895302-10895324 | AUGGAGUUGGGGCCCCUAGA | 7745 |
| CR002968 | CIITA | + | Chr16: 10895305-10895327 | GAGUUGGGGCCCCUAGAAGG | 7746 |
| CR002969 | CIITA | + | Chr16: 10895313-10895335 | GCCCCUAGAAGGUGGCUACC | 7747 |
| CR002970 | CIITA | - | Chr16: 10895314-10895336 | UCCAGGUAGCCACCUUCUAG | 7748 |
| CR002971 | CIITA | - | Chr16: 10895315-10895337 | CUCCAGGUAGCCACCUUCUA | 7749 |
| CR002972 | CIITA | - | Chr16: 10895316-10895338 | GCUCCAGGUAGCCACCUUCU | 7750 |
| CR002973 | CIITA | - | Chr16: 10895331-10895353 | CAUCGCUGUUAAGAAGCUCC | 7751 |
| CR002974 | CIITA | - | Chr16: 10895358-10895380 | AGAAGUGGUAGAGGCACAGG | 7752 |
| CR002975 | CIITA | - | Chr16: 10895359-10895381 | UAGAAGUGGUAGAGGCACAG | 7753 |
| CR002976 | CIITA | - | Chr16: 10895360-10895382 | AUAGAAGUGGUAGAGGCACA | 7754 |
| CR002977 | CIITA | - | Chr16: 10895361-10895383 | CAUAGAAGUGGUAGAGGCAC | 7755 |
| CR002978 | CIITA | - | Chr16: 10895367-10895389 | UCUGGUCAUAGAAGUGGUAG | 7756 |
| CR002979 | CIITA | + | Chr16: 10895370-10895392 | CUACCACUUCUAUGACCAGA | 7757 |
| CR002980 | CIITA | - | Chr16: 10895373-10895395 | GGUCCAUCUGGUCAUAGAAG | 7758 |
| CR002981 | CIITA | + | Chr16: 10895376-10895398 | CUUCUAUGACCAGAUGGACC | 7759 |
| CR002982 | CIITA | + | Chr16: 10895380-10895402 | UAUGACCAGAUGGACCUGGC | 7760 |
| CR002983 | CIITA | - | Chr16: 10895385-10895407 | CUUCUCCAGCCAGGUCCAUC | 7761 |
| CR002984 | CIITA | - | Chr16: 10895394-10895416 | CAAUCUCUUCUUCUCCAGCC | 7762 |
| CR002985 | CIITA | - | Chr16: 10895671-10895693 | CAGUUGAUGGUGUCUGUGUC | 7763 |
| CR002986 | CIITA | - | Chr16: 10895672-10895694 | GCAGUUGAUGGUGUCUGUGU | 7764 |

TABLE 6c-continued gRNA Targeting Domains for human CIITA

| Id | Target | Strand | Chromosomal location | gRNA targeting domain sequence | SEQ ID NO: |
|---|---|---|---|---|---|
| CR002987 | CIITA | - | Chr16: 10895684-10895706 | GCUGAACUGGUCGCAGUUGA | 7765 |
| CR002988 | CIITA | + | Chr16: 10895687-10895709 | UCAACUGCGACCAGUUCAGC | 7766 |
| CR002989 | CIITA | - | Chr16: 10895697-10895719 | CACACAACAGCCUGCUGAAC | 7767 |
| CR002990 | CIITA | + | Chr16: 10895703-10895725 | CAGCAGGCUGUUGUGUGACA | 7768 |
| CR002991 | CIITA | + | Chr16: 10895707-10895729 | AGGCUGUUGUGUGACAUGGA | 7769 |
| CR002992 | CIITA | + | Chr16: 10895723-10895745 | UGGAAGGUGAUGAAGAGACC | 7770 |
| CR002993 | CIITA | + | Chr16: 10895724-10895746 | GGAAGGUGAUGAAGAGACCA | 7771 |
| CR002994 | CIITA | + | Chr16: 10895727-10895749 | AGGUGAUGAAGAGACCAGGG | 7772 |
| CR002995 | CIITA | - | Chr16: 10895741-10895763 | GAUAUUGGCAUAAGCCUCCC | 7773 |
| CR002996 | CIITA | - | Chr16: 10895756-10895778 | AGGUGCUUCCUCACCGAUAU | 7774 |
| CR002997 | CIITA | + | Chr16: 10898674-10898696 | ACUGGACCAGUAUGUCUUCC | 7775 |
| CR002998 | CIITA | - | Chr16: 10898680-10898702 | GGGAGUCCUGGAAGACAUAC | 7776 |
| CR002999 | CIITA | + | Chr16: 10898686-10898708 | UGUCUUCCAGGACUCCCAGC | 7777 |
| CR003000 | CIITA | + | Chr16: 10898689-10898711 | CUUCCAGGACUCCCAGCUGG | 7778 |
| CR003001 | CIITA | + | Chr16: 10898690-10898712 | UUCCAGGACUCCCAGCUGGA | 7779 |
| CR003002 | CIITA | - | Chr16: 10898692-10898714 | GGCCUCCAGCUGGGAGUCC | 7780 |
| CR003003 | CIITA | - | Chr16: 10898700-10898722 | CUUGCUCAGGCCCUCCAGCU | 7781 |
| CR003004 | CIITA | - | Chr16: 10898701-10898723 | CCUUGCUCAGGCCCUCCAGC | 7782 |
| CR003005 | CIITA | + | Chr16: 10898701-10898723 | CCAGCUGGAGGGCCUGAGCA | 7783 |
| CR003006 | CIITA | - | Chr16: 10898713-10898735 | UACUGAAAAUGUCCUUGCUC | 7784 |
| CR003007 | CIITA | + | Chr16: 10898930-10898952 | AUAGGACCAGAUGAAGUGAU | 7785 |
| CR003008 | CIITA | - | Chr16: 10898936-10898958 | CUCUCACCGAUCACUUCAUC | 7786 |
| CR003009 | CIITA | + | Chr16: 10898941-10898963 | UGAAGUGAUCGGUGAGAGUA | 7787 |
| CR003010 | CIITA | + | Chr16: 10898960-10898982 | AUGGAGAUGCCAGCAGAAGU | 7788 |
| CR003011 | CIITA | + | Chr16: 10898961-10898983 | UGGAGAUGCCAGCAGAAGUU | 7789 |

TABLE 6c-continued gRNA Targeting Domains for human CIITA

| Id | Target | Strand | Chromosomal location | gRNA targeting domain sequence | SEQ ID NO: |
|---|---|---|---|---|---|
| CR003012 | CIITA | − | Chr16: 10898969-10898991 | CUUUUCUGCCCAACUUCUGC | 7790 |
| CR003013 | CIITA | − | Chr16: 10901514-10901536 | UGCCGGAAGCUCCUCUGGGA | 7791 |
| CR003014 | CIITA | − | Chr16: 10901518-10901540 | GGUCUGCCGGAAGCUCCUCU | 7792 |
| CR003015 | CIITA | − | Chr16: 10901519-10901541 | AGGUCUGCCGGAAGCUCCUC | 7793 |
| CR003016 | CIITA | + | Chr16: 10901529-10901551 | UUCCGGCAGACCUGAAGCAC | 7794 |
| CR003017 | CIITA | − | Chr16: 10901531-10901553 | UUCCAGUGCUUCAGGUCUGC | 7795 |
| CR003018 | CIITA | + | Chr16: 10902040-10902062 | GAGCCCCCACUGUGGUGAC | 7796 |
| CR003019 | CIITA | − | Chr16: 10902043-10902065 | CUGCCAGUCACCACAGUGGG | 7797 |
| CR003020 | CIITA | − | Chr16: 10902044-10902066 | ACUGCCAGUCACCACAGUGG | 7798 |
| CR003021 | CIITA | − | Chr16: 10902045-10902067 | GACUGCCAGUCACCACAGUG | 7799 |
| CR003022 | CIITA | − | Chr16: 10902046-10902068 | AGACUGCCAGUCACCACAGU | 7800 |
| CR003023 | CIITA | − | Chr16: 10902047-10902069 | GAGACUGCCAGUCACCACAG | 7801 |
| CR003024 | CIITA | + | Chr16: 10902054-10902076 | GGUGACUGGCAGUCUCCUAG | 7802 |
| CR003025 | CIITA | + | Chr16: 10902055-10902077 | GUGACUGGCAGUCUCCUAGU | 7803 |
| CR003026 | CIITA | − | Chr16: 10902069-10902091 | AGUCGCUCACUGGUCCCACU | 7804 |

In the various aspects of the invention, the gRNA molecule may include a targeting domain listed above. In an embodiment, the targeting domain of the gRNA of the invention comprises, e.g. consists of, the targeting domain of CR002939. In an embodiment, the targeting domain of the gRNA of the invention comprises, e.g. consists of, the targeting domain of CR002940. In an embodiment, the targeting domain of the gRNA of the invention comprises, e.g. consists of, the targeting domain of CR002941. In an embodiment, the targeting domain of the gRNA of the invention comprises, e.g. consists of, the targeting domain of CR002942. In an embodiment, the targeting domain of the gRNA of the invention comprises, e.g. consists of, the targeting domain of CR002943. In an embodiment, the targeting domain of the gRNA of the invention comprises, e.g. consists of, the targeting domain of CR002944. In an embodiment, the targeting domain of the gRNA of the invention comprises, e.g. consists of, the targeting domain of CR002945. In an embodiment, the targeting domain of the gRNA of the invention comprises, e.g. consists of, the targeting domain of CR002946. In an embodiment, the targeting domain of the gRNA of the invention comprises, e.g. consists of, the targeting domain of CR002947. In an embodiment, the targeting domain of the gRNA of the invention comprises, e.g. consists of, the targeting domain of CR002948. In an embodiment, the targeting domain of the gRNA of the invention comprises, e.g. consists of, the targeting domain of CR002949. In an embodiment, the targeting domain of the gRNA of the invention comprises, e.g. consists of, the targeting domain of CR002950. In an embodiment, the targeting domain of the gRNA of the invention comprises, e.g. consists of, the targeting domain of CR002951. In an embodiment, the targeting domain of the gRNA of the invention comprises, e.g. consists of, the targeting domain of CR002952. In an embodiment, the targeting domain of the gRNA of the invention comprises, e.g. consists of, the targeting domain of CR002953. In an embodiment, the targeting domain of the gRNA of the invention comprises, e.g. consists of, the targeting domain of CR002954. In an embodiment, the targeting domain of the gRNA of the invention comprises, e.g. consists of, the targeting domain of CR002955. In an embodiment, the targeting domain of the gRNA of the invention comprises, e.g. consists of, the targeting domain of CR002956. In an embodiment, the targeting domain of the gRNA of the invention comprises, e.g. consists of, the targeting domain of CR002957. In an embodiment, the targeting domain of the gRNA of the invention comprises, e.g. consists of, the targeting domain of CR002958. In an embodiment, the targeting domain of the gRNA of the invention comprises, e.g. consists of, the targeting domain of CR002959. In an embodiment, the targeting domain of the gRNA of the invention comprises, e.g. consists of, the targeting domain of CR002960. In an embodiment, the targeting domain of the gRNA of the invention comprises, e.g. consists of, the targeting domain of CR002961. In an embodiment, the targeting domain of the gRNA of the invention comprises, e.g. consists of, the targeting domain of CR002962. In an embodiment, the targeting domain of the gRNA of the invention comprises, e.g. consists of, the targeting domain of CR002963. In an embodiment, the targeting domain of the gRNA of the invention comprises, e.g. consists of, the targeting domain of CR002964. In an embodiment, the targeting domain of the gRNA of the invention comprises, e.g. consists of, the targeting domain of CR002965. In an embodiment, the targeting domain of the gRNA of the invention comprises, e.g. consists of, the targeting domain of CR002966. In an embodiment, the targeting domain of the gRNA of the invention comprises, e.g. consists of, the targeting domain of CR002967. In an embodiment, the targeting domain of the gRNA of the invention comprises, e.g. consists of, the targeting domain of CR002968. In an embodiment, the targeting domain of the gRNA of the invention comprises, e.g. consists of, the targeting domain of CR002969. In an embodiment, the targeting domain of the gRNA of the invention comprises, e.g. consists of, the targeting domain of CR002970. In an embodiment, the targeting domain of the gRNA of the invention comprises, e.g. consists of, the targeting domain of CR002971. In an embodiment, the targeting domain of the gRNA of the invention comprises, e.g. consists of, the targeting domain of CR002972. In an embodiment, the targeting domain of the gRNA of the invention comprises, e.g. consists of, the targeting domain of CR002973. In an embodiment, the targeting domain of the gRNA of the invention comprises, e.g. consists of, the targeting domain of CR002974. In an embodiment, the targeting domain of the gRNA of the invention comprises, e.g. consists of, the targeting domain of CR002975. In an embodiment, the targeting domain of the gRNA of the invention comprises, e.g. consists of, the targeting domain of CR002976. In an embodiment, the targeting domain of the gRNA of the invention comprises, e.g. consists of, the targeting domain of CR002977. In an embodiment, the targeting domain of the gRNA of the invention comprises, e.g. consists of, the targeting domain of CR002978. In an embodiment, the targeting domain of the gRNA of the invention comprises, e.g. consists of, the targeting domain of CR002979. In an embodiment, the targeting domain of the gRNA of the invention comprises, e.g. consists of, the targeting domain of CR002980. In an embodiment, the targeting domain of the gRNA of the invention comprises, e.g. consists of, the targeting domain of CR002981. In an embodiment, the targeting domain of the gRNA of the invention comprises, e.g. consists of, the targeting domain of CR002982. In an embodiment, the targeting domain of the gRNA of the invention comprises, e.g. consists of, the targeting domain of CR002983. In an embodiment, the targeting domain of the gRNA of the invention comprises, e.g. consists of, the targeting domain of CR002984. In an embodiment, the targeting domain of the gRNA of the invention comprises, e.g. consists of, the targeting domain of CR002985. In an embodiment, the targeting domain of the gRNA of the invention comprises, e.g. consists of, the targeting domain of CR002986. In an embodiment, the targeting domain of the gRNA of the invention comprises, e.g. consists of, the targeting domain of CR002987. In an embodiment, the targeting domain of the gRNA of the invention comprises, e.g. consists of, the targeting domain of CR002988. In an embodiment, the targeting domain of the gRNA of the invention comprises, e.g. consists of, the targeting domain of CR002989. In an embodiment, the targeting domain of the gRNA of the invention comprises, e.g. consists of, the targeting domain of CR002990. In an embodiment, the targeting domain of the gRNA of the invention comprises, e.g. consists of, the targeting domain of CR002991. In an embodiment, the targeting domain of the gRNA of the invention comprises, e.g. consists of, the targeting domain of CR002992. In an embodiment, the targeting domain of the gRNA of the invention comprises, e.g. consists of, the targeting domain of CR002993. In an embodiment, the targeting domain of the gRNA of the invention comprises, e.g. consists of, the targeting domain of CR002994. In an embodiment, the targeting domain of the gRNA of the invention comprises, e.g. consists of, the targeting domain of CR002995. In an embodiment, the targeting domain of the gRNA of the invention comprises, e.g. consists of, the targeting domain of CR002996. In an embodiment, the targeting domain of the gRNA of the invention comprises, e.g. consists of, the targeting domain of CR002997. In an embodiment, the targeting domain of the gRNA of the invention comprises, e.g. consists of, the targeting domain of CR002998. In an embodiment, the targeting domain of the gRNA of the invention comprises, e.g. consists of, the targeting domain of CR002999. In an embodiment, the targeting domain of the gRNA of the invention comprises, e.g. consists of, the targeting domain of CR003000. In an embodiment, the targeting domain of the gRNA of the invention comprises, e.g. consists of, the targeting domain of CR003001. In an embodiment, the targeting domain of the gRNA of the invention comprises, e.g. consists of, the targeting domain of CR003002. In an embodiment, the targeting domain of the gRNA of the invention comprises, e.g. consists of, the targeting domain of CR003003. In an embodiment, the targeting domain of the gRNA of the invention comprises, e.g. consists of, the targeting domain of CR003004. In an embodiment, the targeting domain of the gRNA of the invention comprises, e.g. consists of, the targeting domain of CR003005. In an embodiment, the targeting domain of the gRNA of the invention comprises, e.g. consists of, the targeting domain of CR003006. In an embodiment, the targeting domain of the gRNA of the invention comprises, e.g. consists of, the targeting domain of CR003007. In an embodiment, the targeting domain of the gRNA of the invention comprises, e.g. consists of, the targeting domain of CR003008. In an embodiment, the targeting domain of the gRNA of the invention comprises, e.g. consists of, the targeting domain of CR003009. In an embodiment, the targeting domain of the gRNA of the invention comprises, e.g. consists of, the targeting domain of CR003010. In an embodiment, the targeting domain of the gRNA of the invention comprises, e.g. consists of, the targeting domain of CR003011. In an embodiment, the targeting domain of the gRNA of the invention comprises, e.g. consists of, the targeting domain of CR003012. In an embodiment, the targeting domain of the gRNA of the invention comprises, e.g. consists of, the targeting domain of CR003013. In an embodiment, the targeting domain of the gRNA of the invention comprises, e.g. consists of, the targeting domain of CR003014. In an embodiment, the targeting domain of the gRNA of the invention comprises, e.g. consists of, the targeting domain of CR003015. In an embodiment, the targeting domain of the gRNA of the invention comprises, e.g. consists of, the targeting domain of CR003016. In an embodiment, the targeting domain of the gRNA of the invention comprises, e.g. consists of, the targeting domain of CR003017. In an embodiment, the targeting domain of the gRNA of the invention comprises, e.g. consists of, the targeting domain of CR003018. In an embodiment, the targeting domain of the gRNA of the invention comprises, e.g. consists of, the targeting domain of CR003019. In an embodiment, the targeting domain of the gRNA of the invention comprises, e.g. consists of, the targeting domain of CR003020. In an embodiment, the targeting domain of the gRNA of the invention comprises, e.g. consists of, the targeting domain of CR003021. In an embodiment, the targeting domain of the gRNA of the invention comprises, e.g. consists of, the targeting domain of CR003022. In an embodiment, the targeting domain of the gRNA of the invention comprises, e.g. consists of, the targeting domain of CR003023. In an embodiment, the targeting domain of the gRNA of the invention comprises, e.g. consists of, the targeting domain of CR003024. In an embodiment, the targeting domain of the gRNA of the invention comprises, e.g. consists of, the targeting domain of CR003025. In an embodiment, the targeting domain of the gRNA of the invention comprises, e.g. consists of, the targeting domain of CR003026. Such gRNA molecules, and combinations thereof, are suitable for use in, for example, the CRISPR systems, methods and cells and other aspects of the invention described herein.

TABLE 6d

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_2_1 | LILRB1 | EXON | + | chr19: 54630390-54630410 | UAAAAGGGGAAGUUAAGAG | 10090 |
| 10859_2_2 | LILRB1 | EXON | + | chr19: 54630399-54630419 | GAAGUUAAGAGGGGACUAUU | 10091 |
| 10859_2_23 | LILRB1 | EXON | + | chr19: 54630503-54630523 | CUGCCACACGCAGCUCAGCC | 10092 |
| 10859_2_24 | LILRB1 | EXON | + | chr19: 54630504-54630524 | UGCCACACGCAGCUCAGCCU | 10093 |
| 10859_2_25 | LILRB1 | EXON | + | chr19: 54630507-54630527 | CACACGCAGCUCAGCCUGGG | 10094 |
| 10859_2_29 | LILRB1 | EXON | + | chr19: 54630560-54630580 | AUCUGAGUCUGCCUGCAGCA | 10095 |
| 10859_2_31 | LILRB1 | EXON | + | chr19: 54630566-54630586 | GUCUGCCUGCAGCAUGGACC | 10096 |
| 10859_2_32 | LILRB1 | EXON | + | chr19: 54630567-54630587 | UCUGCCUGCAGCAUGGACCU | 10097 |
| 10859_2_35 | LILRB1 | EXON | + | chr19: 54630589-54630609 | GUCUUCCCUGAAGCAUCUCC | 10098 |
| 10859_2_36 | LILRB1 | EXON | + | chr19: 54630590-54630610 | UCUUCCCUGAAGCAUCUCCA | 10099 |
| 10859_2_39 | LILRB1 | EXON | + | chr19: 54630594-54630614 | CCCUGAAGCAUCUCCAGGGC | 10100 |
| 10859_2_42 | LILRB1 | EXON | + | chr19: 54630597-54630617 | UGAAGCAUCUCCAGGGCUGG | 10101 |
| 10859_2_44 | LILRB1 | EXON | + | chr19: 54630598-54630618 | GAAGCAUCUCCAGGGCUGGA | 10102 |
| 10859_2_45 | LILRB1 | EXON | + | chr19: 54630611-54630631 | GGCUGGAGGGACGACUGCCA | 10103 |
| 10859_2_47 | LILRB1 | EXON | + | chr19: 54630616-54630636 | GAGGGACGACUGCCAUGGUA | 10104 |
| 10859_2_58 | LILRB1 | EXON | - | chr19: 54630436-54630456 | CUUUCUUGACACUGGAUUGU | 10105 |
| 10859_2_60 | LILRB1 | EXON | - | chr19: 54630437-54630457 | UCUUUCUUGACACUGGAUUG | 10106 |
| 10859_2_62 | LILRB1 | EXON | - | chr19: 54630444-54630464 | GUUGACUUCUUUCUUGACAC | 10107 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_2_65 | LILRB1 | EXON | - | chr19: 54630474-54630494 | AAGAGAAAUGCAGGGAAAUA | 10108 |
| 10859_2_67 | LILRB1 | EXON | - | chr19: 54630475-54630495 | GAAGAGAAAUGCAGGGAAAU | 10109 |
| 10859_2_70 | LILRB1 | EXON | - | chr19: 54630482-54630502 | GAGCACAGAAGAGAAAUGCA | 10110 |
| 10859_2_72 | LILRB1 | EXON | - | chr19: 54630483-54630503 | UGAGCACAGAAGAGAAAUGC | 10111 |
| 10859_2_80 | LILRB1 | EXON | - | chr19: 54630509-54630529 | CGCCCAGGCUGAGCUGCGUG | 10112 |
| 10859_2_82 | LILRB1 | EXON | - | chr19: 54630524-54630544 | CGCAUCUGGCUGUGCCGCCC | 10113 |
| 10859_2_83 | LILRB1 | EXON | - | chr19: 54630538-54630558 | GCAGAGACGCAUCUCGCAUC | 10114 |
| 10859_2_85 | LILRB1 | EXON | - | chr19: 54630574-54630594 | AAGACCCAGGUCCAUGCUGC | 10115 |
| 10859_2_87 | LILRB1 | EXON | - | chr19: 54630587-54630607 | AGAUGCUUCAGGGAAGACCC | 10116 |
| 10859_2_88 | LILRB1 | EXON | - | chr19: 54630597-54630617 | CCAGCCCUGGAGAUGCUUCA | 10117 |
| 10859_2_90 | LILRB1 | EXON | - | chr19: 54630598-54630618 | UCCAGCCCUGGAGAUGCUUC | 10118 |
| 10859_2_94 | LILRB1 | EXON | - | chr19: 54630610-54630630 | GGCAGUCGUCCCUCCAGCCC | 10119 |
| 10859_2_98 | LILRB1 | EXON | - | chr19: 54630631-54630651 | GUGUUGUGGGGUCCUUACCA | 10120 |
| 10859_3_3 | LILRB1 | EXON | + | chr19: 54631010-54631030 | UCUCUAUCCUGCCAGCACCG | 10121 |
| 10859_3_4 | LILRB1 | EXON | + | chr19: 54631011-54631031 | CUCUAUCCUGCCAGCACCGA | 10122 |
| 10859_3_7 | LILRB1 | EXON | + | chr19: 54631032-54631052 | GGCUCAUCCAUCCACAGAGC | 10123 |
| 10859_3_8 | LILRB1 | EXON | + | chr19: 54631033-54631053 | GCUCAUCCAUCCACAGAGCA | 10124 |
| 10859_3_10 | LILRB1 | EXON | + | chr19: 54631039-54631059 | CCAUCCACAGAGCAGGGCAG | 10125 |
| 10859_3_12 | LILRB1 | EXON | + | chr19: 54631040-54631060 | CAUCCACAGAGCAGGGCAGU | 10126 |
| 10859_3_15 | LILRB1 | EXON | + | chr19: 54631043-54631063 | CCACAGAGCAGGGCAGUGGG | 10127 |
| 10859_3_17 | LILRB1 | EXON | + | chr19: 54631069-54631089 | CGCCAUGACCCCCAUCCUCA | 10128 |
| 10859_3_18 | LILRB1 | EXON | + | chr19: 54631085-54631105 | CUCACGGUCCUGAUCUGUCU | 10129 |
| 10859_3_24 | LILRB1 | EXON | + | chr19: 54631101-54631121 | GUCUCGGUGAGAUUUGAAGA | 10130 |
| 10859_3_25 | LILRB1 | EXON | + | chr19: 54631104-54631124 | UCGGUGAGAUUUGAAGAAGG | 10131 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_3_28 | LILRB1 | EXON | - | chr19: 54631020-54631040 | GAUGAGCCCUCGGUGCUGGC | 10132 |
| 10859_3_30 | LILRB1 | EXON | - | chr19: 54631024-54631044 | GAUGGAUGAGCCCUCGGUGC | 10133 |
| 10859_3_31 | LILRB1 | EXON | - | chr19: 54631030-54631050 | UCUGUGGAUGGAUGAGCCCU | 10134 |
| 10859_3_33 | LILRB1 | EXON | - | chr19: 54631042-54631062 | CCACUGCCCUGCUCUGUGGA | 10135 |
| 10859_3_35 | LILRB1 | EXON | - | chr19: 54631046-54631066 | CCUCCCACUGCCCUGCUCUG | 10136 |
| 10859_3_37 | LILRB1 | EXON | - | chr19: 54631074-54631094 | GACCGUGAGGAUGGGGGUCA | 10137 |
| 10859_3_38 | LILRB1 | EXON | - | chr19: 54631080-54631100 | GAUCAGGACCGUGAGGAUGG | 10138 |
| 10859_3_39 | LILRB1 | EXON | - | chr19: 54631081-54631101 | AGAUCAGGACCGUGAGGAUG | 10139 |
| 10859_3_40 | LILRB1 | EXON | - | chr19: 54631082-54631102 | CAGAUCAGGACCGUGAGGAU | 10140 |
| 10859_3_42 | LILRB1 | EXON | - | chr19: 54631083-54631103 | ACAGAUCAGGACCGUGAGGA | 10141 |
| 10859_3_45 | LILRB1 | EXON | - | chr19: 54631087-54631107 | CGAGACAGAUCAGGACCGUG | 10142 |
| 10859_3_50 | LILRB1 | EXON | - | chr19: 54631096-54631116 | AAAUCUCACCGAGACAGAUC | 10143 |
| 10859_4_3 | LILRB1 | EXON | + | chr19: 54631259-54631279 | CUCUCUUCCAGGGCUGAGUC | 10144 |
| 10859_4_4 | LILRB1 | EXON | + | chr19: 54631260-54631280 | UCUCUUCCAGGGCUGAGUCU | 10145 |
| 10859_4_7 | LILRB1 | EXON | + | chr19: 54631267-54631287 | CAGGGCUGAGUCUGGGCCCC | 10146 |
| 10859_4_8 | LILRB1 | EXON | + | chr19: 54631280-54631300 | GGGCCCCCGGACCCACGUGC | 10147 |
| 10859_4_9 | LILRB1 | EXON | + | chr19: 54631284-54631304 | CCCCGGACCCACGUGCAGGC | 10148 |
| 10859_4_11 | LILRB1 | EXON | - | chr19: 54631255-54631275 | CAGCCCUGGAAGAGAGUUCC | 10149 |
| 10859_4_15 | LILRB1 | EXON | - | chr19: 54631269-54631289 | CGGGGGCCCAGACUCAGCCC | 10150 |
| 10859_4_17 | LILRB1 | EXON | - | chr19: 54631286-54631306 | CUGCCUGCACGUGGGUCGG | 10151 |
| 10859_4_18 | LILRB1 | EXON | - | chr19: 54631287-54631307 | CCUGCCUGCACGUGGGUCCG | 10152 |
| 10859_4_20 | LILRB1 | EXON | - | chr19: 54631288-54631308 | ACCUGCCUGCACGUGGGUCC | 10153 |
| 10859_4_21 | LILRB1 | EXON | - | chr19: 54631289-54631309 | CACCUGCCUGCACGUGGGUC | 10154 |
| 10859_4_24 | LILRB1 | EXON | - | chr19: 54631294-54631314 | AGACUCACCUGCCUGCACGU | 10155 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_4_25 | LILRB1 | EXON | - | chr19: 54631295-54631315 | CAGACUCACCUGCCUGCACG | 10156 |
| 10859_5_5 | LILRB1 | EXON | + | chr19: 54631502-54631522 | ACCUCCCAAGCCCACCCUC | 10157 |
| 10859_5_6 | LILRB1 | EXON | + | chr19: 54631503-54631523 | CCUCCCAAGCCCACCCUCU | 10158 |
| 10859_5_8 | LILRB1 | EXON | + | chr19: 54631513-54631533 | CCCACCCUCUGGGCUGAACC | 10159 |
| 10859_5_10 | LILRB1 | EXON | + | chr19: 54631530-54631550 | ACCAGGCUCUGUGAUCACCC | 10160 |
| 10859_5_12 | LILRB1 | EXON | + | chr19: 54631531-54631551 | CCAGGCUCUGUGAUCACCCA | 10161 |
| 10859_5_15 | LILRB1 | EXON | + | chr19: 54631532-54631552 | CAGGCUCUGUGAUCACCCAG | 10162 |
| 10859_5_16 | LILRB1 | EXON | + | chr19: 54631550-54631570 | AGGGGAGUCCUGUGACCCUC | 10163 |
| 10859_5_19 | LILRB1 | EXON | + | chr19: 54631557-54631577 | UCCUGUGACCCUCAGGUGUC | 10164 |
| 10859_5_20 | LILRB1 | EXON | + | chr19: 54631558-54631578 | CCUGUGACCCUCAGGUGUCA | 10165 |
| 10859_5_22 | LILRB1 | EXON | + | chr19: 54631559-54631579 | CUGUGACCCUCAGGUGUCAG | 10166 |
| 10859_5_24 | LILRB1 | EXON | + | chr19: 54631560-54631580 | UGUGACCCUCAGGUGUCAGG | 10167 |
| 10859_5_25 | LILRB1 | EXON | + | chr19: 54631561-54631581 | GUGACCCUCAGGUGUCAGGG | 10168 |
| 10859_5_28 | LILRB1 | EXON | + | chr19: 54631566-54631586 | CCUCAGGUGUCAGGGGGCC | 10169 |
| 10859_5_30 | LILRB1 | EXON | + | chr19: 54631575-54631595 | UCAGGGGGCCAGGAGACCC | 10170 |
| 10859_5_38 | LILRB1 | EXON | + | chr19: 54631613-54631633 | GAGAAAAGAAAACAGCACCC | 10171 |
| 10859_5_40 | LILRB1 | EXON | + | chr19: 54631622-54631642 | AAACAGCACCCUGGAUUACA | 10172 |
| 10859_5_42 | LILRB1 | EXON | + | chr19: 54631632-54631652 | CUGGAUUACACGGAUCCCAC | 10173 |
| 10859_5_48 | LILRB1 | EXON | + | chr19: 54631647-54631667 | CCCACAGGAGCUUGUGAAGA | 10174 |
| 10859_5_49 | LILRB1 | EXON | + | chr19: 54631648-54631668 | CCACAGGAGCUUGUGAAGAA | 10175 |
| 10859_5_53 | LILRB1 | EXON | + | chr19: 54631676-54631696 | UCCCAUCCCAUCCAUCACC | 10176 |
| 10859_5_54 | LILRB1 | EXON | + | chr19: 54631677-54631697 | CCCAUCCCAUCCAUCACCU | 10177 |
| 10859_5_58 | LILRB1 | EXON | + | chr19: 54631687-54631707 | UCCAUCACCUGGGAACACAC | 10178 |
| 10859_5_59 | LILRB1 | EXON | + | chr19: 54631688-54631708 | CCAUCACCUGGGAACACACA | 10179 |
| 10859_5_60 | LILRB1 | EXON | + | chr19: 54631691-54631711 | UCACCUGGGAACACACAGGG | 10180 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_5_61 | LILRB1 | EXON | + | chr19: 54631708-54631728 | GGGCGGUAUCGCUGUUACUA | 10181 |
| 10859_5_62 | LILRB1 | EXON | + | chr19: 54631723-54631743 | UACUAUGGUAGCGACACUGC | 10182 |
| 10859_5_68 | LILRB1 | EXON | + | chr19: 54631749-54631769 | CUCAGAGAGCAGUGACCCCC | 10183 |
| 10859_5_69 | LILRB1 | EXON | + | chr19: 54631755-54631775 | GAGCAGUGACCCCUGGAGC | 10184 |
| 10859_5_70 | LILRB1 | EXON | + | chr19: 54631758-54631778 | CAGUGACCCCUGGAGCUGG | 10185 |
| 10859_5_71 | LILRB1 | EXON | + | chr19: 54631765-54631785 | CCCCUGGAGCUGGUGGUGAC | 10186 |
| 10859_5_75 | LILRB1 | EXON | + | chr19: 54631781-54631801 | UGACAGGUGAGCUGACACUC | 10187 |
| 10859_5_76 | LILRB1 | EXON | + | chr19: 54631782-54631802 | GACAGGUGAGCUGACACUCA | 10188 |
| 10859_5_77 | LILRB1 | EXON | + | chr19: 54631783-54631803 | ACAGGUGAGCUGACACUCAG | 10189 |
| 10859_5_79 | LILRB1 | EXON | - | chr19: 54631486-54631506 | AGGUGCCCUGGAAGGAAAUC | 10190 |
| 10859_5_82 | LILRB1 | EXON | - | chr19: 54631494-54631514 | GCUUGGGGAGGUGCCCUGGA | 10191 |
| 10859_5_85 | LILRB1 | EXON | - | chr19: 54631498-54631518 | GUGGGCUUGGGGAGGUGCCC | 10192 |
| 10859_5_89 | LILRB1 | EXON | - | chr19: 54631506-54631526 | CCCAGAGGGUGGGCUUGGGG | 10193 |
| 10859_5_90 | LILRB1 | EXON | - | chr19: 54631509-54631529 | CAGCCCAGAGGGUGGGCUUG | 10194 |
| 10859_5_92 | LILRB1 | EXON | - | chr19: 54631510-54631530 | UCAGCCCAGAGGGUGGGCUU | 10195 |
| 10859_5_95 | LILRB1 | EXON | - | chr19: 54631511-54631531 | UUCAGCCCAGAGGGUGGGCU | 10196 |
| 10859_5_97 | LILRB1 | EXON | - | chr19: 54631516-54631536 | CCUGGUUCAGCCCAGAGGGU | 10197 |
| 10859_5_98 | LILRB1 | EXON | - | chr19: 54631517-54631537 | GCCUGGUUCAGCCCAGAGGG | 10198 |
| 10859_5_100 | LILRB1 | EXON | - | chr19: 54631520-54631540 | AGAGCCUGGUUCAGCCCAGA | 10199 |
| 10859_5_101 | LILRB1 | EXON | - | chr19: 54631521-54631541 | CAGAGCCUGGUUCAGCCCAG | 10200 |
| 10859_5_104 | LILRB1 | EXON | - | chr19: 54631534-54631554 | CCCUGGGUGAUCACAGAGCC | 10201 |
| 10859_5_106 | LILRB1 | EXON | - | chr19: 54631550-54631570 | GAGGGUCACAGGACUCCCCU | 10202 |
| 10859_5_107 | LILRB1 | EXON | - | chr19: 54631551-54631571 | UGAGGGUCACAGGACUCCCC | 10203 |
| 10859_5_109 | LILRB1 | EXON | - | chr19: 54631561-54631581 | CCCUGACACCUGAGGGUCAC | 10204 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_5_111 | LILRB1 | EXON | - | chr19: 54631568-54631588 | CUGGCCCCCUGACACCUGA | 10205 |
| 10859_5_112 | LILRB1 | EXON | - | chr19: 54631569-54631589 | CCUGGCCCCCUGACACCUG | 10206 |
| 10859_5_115 | LILRB1 | EXON | - | chr19: 54631587-54631607 | GACGGUACUCCUGGGUCUCC | 10207 |
| 10859_5_119 | LILRB1 | EXON | - | chr19: 54631595-54631615 | UCUAUAUAGACGGUACUCCU | 10208 |
| 10859_5_120 | LILRB1 | EXON | - | chr19: 54631596-54631616 | CUCUAUAUAGACGGUACUCC | 10209 |
| 10859_5_125 | LILRB1 | EXON | - | chr19: 54631605-54631625 | UUUUCUUUUCUCUAUAUAGA | 10210 |
| 10859_5_126 | LILRB1 | EXON | - | chr19: 54631633-54631653 | UGUGGGAUCCGUGUAAUCCA | 10211 |
| 10859_5_127 | LILRB1 | EXON | - | chr19: 54631634-54631654 | CUGUGGGAUCCGUGUAAUCC | 10212 |
| 10859_5_131 | LILRB1 | EXON | - | chr19: 54631650-54631670 | CCUUCUUCACAAGCUCCUGU | 10213 |
| 10859_5_132 | LILRB1 | EXON | - | chr19: 54631651-54631671 | CCCUUCUUCACAAGCUCCUG | 10214 |
| 10859_5_135 | LILRB1 | EXON | - | chr19: 54631674-54631694 | UGAUGGAUGGGAUGGGGAAC | 10215 |
| 10859_5_137 | LILRB1 | EXON | - | chr19: 54631680-54631700 | CCCAGGUGAUGGAUGGGAUG | 10216 |
| 10859_5_140 | LILRB1 | EXON | - | chr19: 54631681-54631701 | UCCCAGGUGAUGGAUGGGAU | 10217 |
| 10859_5_141 | LILRB1 | EXON | - | chr19: 54631682-54631702 | UUCCCAGGUGAUGGAUGGGA | 10218 |
| 10859_5_144 | LILRB1 | EXON | - | chr19: 54631686-54631706 | UGUGUUCCCAGGUGAUGGAU | 10219 |
| 10859_5_146 | LILRB1 | EXON | - | chr19: 54631687-54631707 | GUGUGUUCCCAGGUGAUGGA | 10220 |
| 10859_5_148 | LILRB1 | EXON | - | chr19: 54631691-54631711 | CCCUGUGUGUUCCCAGGUGA | 10221 |
| 10859_5_150 | LILRB1 | EXON | - | chr19: 54631697-54631717 | AUACCGCCCUGUGUGUUCCC | 10222 |
| 10859_5_151 | LILRB1 | EXON | - | chr19: 54631749-54631769 | GGGGGUCACUGCUCUCUGAG | 10223 |
| 10859_5_153 | LILRB1 | EXON | - | chr19: 54631767-54631787 | CUGUCACCACCAGCUCCAGG | 10224 |
| 10859_5_154 | LILRB1 | EXON | - | chr19: 54631768-54631788 | CCUGUCACCACCAGCUCCAG | 10225 |
| 10859_5_155 | LILRB1 | EXON | - | chr19: 54631769-54631789 | ACCUGUCACCACCAGCUCCA | 10226 |
| 10859_5_157 | LILRB1 | EXON | - | chr19: 54631770-54631790 | CACCUGUCACCACCAGCUCC | 10227 |
| 10859_6_2 | LILRB1 | EXON | + | chr19: 54631956-54631976 | CUCAGCCCAGCCCAGCCCCG | 10228 |
| 10859_6_6 | LILRB1 | EXON | + | chr19: 54631966-54631986 | CCCAGCCCCGUGGUGAACUC | 10229 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_6_8 | LILRB1 | EXON | + | chr19: 54631969-54631989 | AGCCCCGUGGUGAACUCAGG | 10230 |
| 10859_6_10 | LILRB1 | EXON | + | chr19: 54631970-54631990 | GCCCCGUGGUGAACUCAGGA | 10231 |
| 10859_6_12 | LILRB1 | EXON | + | chr19: 54631998-54632018 | AACCCUCCAGUGUGACUCAC | 10232 |
| 10859_6_13 | LILRB1 | EXON | + | chr19: 54632001-54632021 | CCUCCAGUGUGACUCACAGG | 10233 |
| 10859_6_14 | LILRB1 | EXON | + | chr19: 54632011-54632031 | GACUCACAGGUGGCAUUUGA | 10234 |
| 10859_6_17 | LILRB1 | EXON | + | chr19: 54632028-54632048 | UGAUGGCUUCAUUCUGUGUA | 10235 |
| 10859_6_21 | LILRB1 | EXON | + | chr19: 54632032-54632052 | GGCUUCAUUCUGUGUAAGGA | 10236 |
| 10859_6_29 | LILRB1 | EXON | + | chr19: 54632080-54632100 | AACUCCCAGCCCCAUGCCCG | 10237 |
| 10859_6_30 | LILRB1 | EXON | + | chr19: 54632081-54632101 | ACUCCCAGCCCCAUGCCCGU | 10238 |
| 10859_6_32 | LILRB1 | EXON | + | chr19: 54632106-54632126 | GUCCCGCGCCAUCUUCUCCG | 10239 |
| 10859_6_33 | LILRB1 | EXON | + | chr19: 54632107-54632127 | UCCCGCGCCAUCUUCUCCGU | 10240 |
| 10859_6_37 | LILRB1 | EXON | + | chr19: 54632129-54632149 | GCCCCGUGAGCCCGAGUCGC | 10241 |
| 10859_6_38 | LILRB1 | EXON | + | chr19: 54632132-54632152 | CCGUGAGCCCGAGUCGCAGG | 10242 |
| 10859_6_39 | LILRB1 | EXON | + | chr19: 54632135-54632155 | UGAGCCCGAGUCGCAGGUGG | 10243 |
| 10859_6_40 | LILRB1 | EXON | + | chr19: 54632141-54632161 | CGAGUCGCAGGUGGUGGUAC | 10244 |
| 10859_6_44 | LILRB1 | EXON | + | chr19: 54632177-54632197 | ACUCGAACUCUCCCUAUGAG | 10245 |
| 10859_6_46 | LILRB1 | EXON | + | chr19: 54632199-54632219 | GUCUCUACCCAGUGAUCUCC | 10246 |
| 10859_6_48 | LILRB1 | EXON | + | chr19: 54632208-54632228 | CAGUGAUCUCCUGGAGCUCC | 10247 |
| 10859_6_49 | LILRB1 | EXON | + | chr19: 54632215-54632235 | CUCCUGGAGCUCCUGGUCCU | 10248 |
| 10859_6_53 | LILRB1 | EXON | - | chr19: 54631921-54631941 | UAGGCUCCUAGGAGAGAAGG | 10249 |
| 10859_6_57 | LILRB1 | EXON | - | chr19: 54631924-54631944 | AUGUAGGCUCCUAGGAGAGA | 10250 |
| 10859_6_62 | LILRB1 | EXON | - | chr19: 54631932-54631952 | UGGGUUUGAUGUAGGCUCCU | 10251 |
| 10859_6_65 | LILRB1 | EXON | - | chr19: 54631940-54631960 | UGAGAGGGUGGGUUUGAUGU | 10252 |
| 10859_6_66 | LILRB1 | EXON | - | chr19: 54631951-54631971 | CUGGGCUGGGCUGAGAGGGU | 10253 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_6_67 | LILRB1 | EXON | - | chr19: 54631952-54631972 | GCUGGGCUGGGCUGAGAGGG | 10254 |
| 10859_6_69 | LILRB1 | EXON | - | chr19: 54631955-54631975 | GGGGCUGGGCUGGGCUGAGA | 10255 |
| 10859_6_70 | LILRB1 | EXON | - | chr19: 54631956-54631976 | CGGGGCUGGGCUGGGCUGAG | 10256 |
| 10859_6_75 | LILRB1 | EXON | - | chr19: 54631964-54631984 | GUUCACCACGGGGCUGGCU | 10257 |
| 10859_6_76 | LILRB1 | EXON | - | chr19: 54631965-54631985 | AGUUCACCACGGGGCUGGGC | 10258 |
| 10859_6_79 | LILRB1 | EXON | - | chr19: 54631969-54631989 | CCUGAGUUCACCACGGGGCU | 10259 |
| 10859_6_80 | LILRB1 | EXON | - | chr19: 54631970-54631990 | UCCUGAGUUCACCACGGGGC | 10260 |
| 10859_6_83 | LILRB1 | EXON | - | chr19: 54631974-54631994 | UCCCUCCUGAGUUCACCACG | 10261 |
| 10859_6_84 | LILRB1 | EXON | - | chr19: 54631975-54631995 | UUCCCUCCUGAGUUCACCAC | 10262 |
| 10859_6_85 | LILRB1 | EXON | - | chr19: 54631976-54631996 | AUUCCCUCCUGAGUUCACCA | 10263 |
| 10859_6_89 | LILRB1 | EXON | - | chr19: 54632003-54632023 | CACCUGUGAGUCACACUGGA | 10264 |
| 10859_6_90 | LILRB1 | EXON | - | chr19: 54632004-54632024 | CCACCUGUGAGUCACACUGG | 10265 |
| 10859_6_92 | LILRB1 | EXON | - | chr19: 54632007-54632027 | AUGCCACCUGUGAGUCACAC | 10266 |
| 10859_6_104 | LILRB1 | EXON | - | chr19: 54632070-54632090 | GCUGGGAGUUCAGGCAUUGU | 10267 |
| 10859_6_105 | LILRB1 | EXON | - | chr19: 54632071-54632091 | GGCUGGGAGUUCAGGCAUUG | 10268 |
| 10859_6_107 | LILRB1 | EXON | - | chr19: 54632079-54632099 | GGGCAUGGGGCUGGGAGUUC | 10269 |
| 10859_6_108 | LILRB1 | EXON | - | chr19: 54632087-54632107 | CGACCCACGGGCAUGGGGCU | 10270 |
| 10859_6_110 | LILRB1 | EXON | - | chr19: 54632088-54632108 | ACGACCCACGGGCAUGGGGC | 10271 |
| 10859_6_113 | LILRB1 | EXON | - | chr19: 54632092-54632112 | CGGGACGACCCACGGGCAUG | 10272 |
| 10859_6_114 | LILRB1 | EXON | - | chr19: 54632093-54632113 | GCGGGACGACCCACGGGCAU | 10273 |
| 10859_6_116 | LILRB1 | EXON | - | chr19: 54632094-54632114 | CGCGGGACGACCCACGGGCA | 10274 |
| 10859_6_118 | LILRB1 | EXON | - | chr19: 54632099-54632119 | GAUGGCGCGGGACGACCCAC | 10275 |
| 10859_6_119 | LILRB1 | EXON | - | chr19: 54632100-54632120 | AGAUGGCGCGGGACGACCCA | 10276 |
| 10859_6_121 | LILRB1 | EXON | - | chr19: 54632111-54632131 | GCCCACGGAGAAGAUGGCGC | 10277 |
| 10859_6_123 | LILRB1 | EXON | - | chr19: 54632112-54632132 | GGCCCACGGAGAAGAUGGCG | 10278 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_6_125 | LILRB1 | EXON | - | chr19: 54632117-54632137 | CACGGGGCCCACGGAGAAGA | 10279 |
| 10859_6_129 | LILRB1 | EXON | - | chr19: 54632126-54632146 | ACUCGGGCUCACGGGGCCCA | 10280 |
| 10859_6_131 | LILRB1 | EXON | - | chr19: 54632133-54632153 | ACCUGCGACUCGGGCUCACG | 10281 |
| 10859_6_132 | LILRB1 | EXON | - | chr19: 54632134-54632154 | CACCUGCGACUCGGGCUCAC | 10282 |
| 10859_6_133 | LILRB1 | EXON | - | chr19: 54632135-54632155 | CCACCUGCGACUCGGGCUCA | 10283 |
| 10859_6_136 | LILRB1 | EXON | - | chr19: 54632142-54632162 | UGUACCACCACCUGCGACUC | 10284 |
| 10859_6_137 | LILRB1 | EXON | - | chr19: 54632143-54632163 | CUGUACCACCACCUGCGACU | 10285 |
| 10859_6_143 | LILRB1 | EXON | - | chr19: 54632191-54632211 | CUGGGUAGAGACCACUCAUA | 10286 |
| 10859_6_144 | LILRB1 | EXON | - | chr19: 54632192-54632212 | ACUGGGUAGAGACCACUCAU | 10287 |
| 10859_6_148 | LILRB1 | EXON | - | chr19: 54632209-54632229 | AGGAGCUCCAGGAGAUCACU | 10288 |
| 10859_6_149 | LILRB1 | EXON | - | chr19: 54632210-54632230 | CAGGAGCUCCAGGAGAUCAC | 10289 |
| 10859_6_154 | LILRB1 | EXON | - | chr19: 54632220-54632240 | CACCUAGGACCAGGAGCUCC | 10290 |
| 10859_6_156 | LILRB1 | EXON | - | chr19: 54632229-54632249 | UGAAUUCUCACCUAGGACC | 10291 |
| 10859_6_159 | LILRB1 | EXON | - | chr19: 54632235-54632255 | AUGCUGUGAAUUCUCACCU | 10292 |
| 10859_77 | LILRB1 | EXON | + | chr19: 54632477-54632497 | CCAUCACUCUCAGUGCAGCC | 10293 |
| 10859_7_8 | LILRB1 | EXON | + | chr19: 54632488-54632508 | AGUGCAGCCAGGUCCUAUCG | 10294 |
| 10859_7_12 | LILRB1 | EXON | + | chr19: 54632497-54632517 | AGGUCCUAUCGUGGCCCCUG | 10295 |
| 10859_7_13 | LILRB1 | EXON | + | chr19: 54632519-54632539 | GAGACCCUGACUCUGCAGUG | 10296 |
| 10859_7_14 | LILRB1 | EXON | + | chr19: 54632531-54632551 | CUGCAGUGUGGCUCUGAUGC | 10297 |
| 10859_7_16 | LILRB1 | EXON | + | chr19: 54632557-54632577 | CAACAGAUUUGUUCUGUAUA | 10298 |
| 10859_7_18 | LILRB1 | EXON | + | chr19: 54632561-54632581 | AGAUUUGUUCUGUAUAAGGA | 10299 |
| 10859_7_21 | LILRB1 | EXON | + | chr19: 54632562-54632582 | GAUUUGUUCUGUAUAAGGAC | 10300 |
| 10859_7_23 | LILRB1 | EXON | + | chr19: 54632563-54632583 | AUUUGUUCUGUAUAAGGACG | 10301 |
| 10859_7_27 | LILRB1 | EXON | + | chr19: 54632588-54632608 | CGUGACUUCCUUCAGCUCGC | 10302 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_7_30 | LILRB1 | EXON | + | chr19: 54632602-54632622 | GCUCGCUGGCGCACAGCCCC | 10303 |
| 10859_7_32 | LILRB1 | EXON | + | chr19: 54632606-54632626 | GCUGGCGCACAGCCCCAGGC | 10304 |
| 10859_7_33 | LILRB1 | EXON | + | chr19: 54632607-54632627 | CUGGCGCACAGCCCCAGGCU | 10305 |
| 10859_7_34 | LILRB1 | EXON | + | chr19: 54632617-54632637 | GCCCCAGGCUGGGCUCUCCC | 10306 |
| 10859_7_36 | LILRB1 | EXON | + | chr19: 54632632-54632652 | CUCCCAGGCCAACUUCACCC | 10307 |
| 10859_7_37 | LILRB1 | EXON | + | chr19: 54632633-54632653 | UCCCAGGCCAACUUCACCCU | 10308 |
| 10859_7_42 | LILRB1 | EXON | + | chr19: 54632654-54632674 | GGCCCUGUGAGCCGCUCCUA | 10309 |
| 10859_7_43 | LILRB1 | EXON | + | chr19: 54632655-54632675 | GCCCUGUGAGCCGCUCCUAC | 10310 |
| 10859_7_45 | LILRB1 | EXON | + | chr19: 54632656-54632676 | CCCUGUGAGCCGCUCCUACG | 10311 |
| 10859_7_46 | LILRB1 | EXON | + | chr19: 54632657-54632677 | CCUGUGAGCCGCUCCUACGG | 10312 |
| 10859_7_47 | LILRB1 | EXON | + | chr19: 54632675-54632695 | GGGGGCCAGUACAGAUGCUA | 10313 |
| 10859_7_49 | LILRB1 | EXON | + | chr19: 54632700-54632720 | CACACAACCUCUCCUCCGAG | 10314 |
| 10859_7_50 | LILRB1 | EXON | + | chr19: 54632704-54632724 | CAACCUCUCCUCCGAGUGGU | 10315 |
| 10859_7_52 | LILRB1 | EXON | + | chr19: 54632722-54632742 | GUCGGCCCCCAGCGACCCCC | 10316 |
| 10859_7_53 | LILRB1 | EXON | + | chr19: 54632738-54632758 | CCCCUGGACAUCCUGAUCGC | 10317 |
| 10859_7_56 | LILRB1 | EXON | + | chr19: 54632743-54632763 | GGACAUCCUGAUCGCAGGUG | 10318 |
| 10859_7_59 | LILRB1 | EXON | + | chr19: 54632753-54632773 | AUCGCAGGUGAGGAGCCCAG | 10319 |
| 10859_7_60 | LILRB1 | EXON | + | chr19: 54632754-54632774 | UCGCAGGUGAGGAGCCCAGC | 10320 |
| 10859_7_61 | LILRB1 | EXON | - | chr19: 54632446-54632466 | CACCUGGGAAAAGGUGGUCA | 10321 |
| 10859_7_64 | LILRB1 | EXON | - | chr19: 54632452-54632472 | UAGAAACACCUGGGAAAAGG | 10322 |
| 10859_7_65 | LILRB1 | EXON | - | chr19: 54632455-54632475 | UCUUAGAAACACCUGGGAAA | 10323 |
| 10859_7_66 | LILRB1 | EXON | - | chr19: 54632461-54632481 | AUGGCUUCUUAGAAACACCU | 10324 |
| 10859_7_68 | LILRB1 | EXON | - | chr19: 54632462-54632482 | GAUGGCUUCUUAGAAACACC | 10325 |
| 10859_7_72 | LILRB1 | EXON | - | chr19: 54632480-54632500 | CCUGGCUGCACUGAGAGUGA | 10326 |
| 10859_7_75 | LILRB1 | EXON | - | chr19: 54632498-54632518 | UCAGGGGCCACGAUAGGACC | 10327 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_7_76 | LILRB1 | EXON | - | chr19: 54632504-54632524 | GUCUCCUCAGGGGCCACGAU | 10328 |
| 10859_7_78 | LILRB1 | EXON | - | chr19: 54632514-54632534 | CAGAGUCAGGGUCUCCUCAG | 10329 |
| 10859_7_79 | LILRB1 | EXON | - | chr19: 54632515-54632535 | GCAGAGUCAGGGUCUCCUCA | 10330 |
| 10859_7_80 | LILRB1 | EXON | - | chr19: 54632516-54632536 | UGCAGAGUCAGGGUCUCCUC | 10331 |
| 10859_7_83 | LILRB1 | EXON | - | chr19: 54632526-54632546 | AGAGCCACACUGCAGAGUCA | 10332 |
| 10859_7_84 | LILRB1 | EXON | - | chr19: 54632527-54632547 | CAGAGCCACACUGCAGAGUC | 10333 |
| 10859_7_93 | LILRB1 | EXON | - | chr19: 54632599-54632619 | GCUGUGCGCCAGCGAGCUGA | 10334 |
| 10859_7_99 | LILRB1 | EXON | - | chr19: 54632621-54632641 | GCCUGGGAGAGCCCAGCCUG | 10335 |
| 10859_7_100 | LILRB1 | EXON | - | chr19: 54632622-54632642 | GGCCUGGGAGAGCCCAGCCU | 10336 |
| 10859_7_102 | LILRB1 | EXON | - | chr19: 54632623-54632643 | UGGCCUGGGAGAGCCCAGCC | 10337 |
| 10859_7_106 | LILRB1 | EXON | - | chr19: 54632637-54632657 | GCCCAGGGUGAAGUUGGCCU | 10338 |
| 10859_7_107 | LILRB1 | EXON | - | chr19: 54632638-54632658 | GGCCCAGGGUGAAGUUGGCC | 10339 |
| 10859_7_110 | LILRB1 | EXON | - | chr19: 54632643-54632663 | CACAGGGCCCAGGGUGAAGU | 10340 |
| 10859_7_112 | LILRB1 | EXON | - | chr19: 54632652-54632672 | GGAGCGGCUCACAGGGCCCA | 10341 |
| 10859_7_113 | LILRB1 | EXON | - | chr19: 54632653-54632673 | AGGAGCGGCUCACAGGGCCC | 10342 |
| 10859_7_115 | LILRB1 | EXON | - | chr19: 54632659-54632679 | CCCCGUAGGAGCGGCUCACA | 10343 |
| 10859_7_116 | LILRB1 | EXON | - | chr19: 54632660-54632680 | CCCCCGUAGGAGCGGCUCAC | 10344 |
| 10859_7_118 | LILRB1 | EXON | - | chr19: 54632668-54632688 | UGUACUGGCCCCGUAGGAG | 10345 |
| 10859_7_119 | LILRB1 | EXON | - | chr19: 54632673-54632693 | GCAUCUGUACUGGCCCCCGU | 10346 |
| 10859_7_123 | LILRB1 | EXON | - | chr19: 54632683-54632703 | GUGCACCGUAGCAUCUGUAC | 10347 |
| 10859_7_124 | LILRB1 | EXON | - | chr19: 54632710-54632730 | GGGCCGACCACUCGGAGGAG | 10348 |
| 10859_7_126 | LILRB1 | EXON | - | chr19: 54632715-54632735 | GCUGGGGCCGACCACUCGG | 10349 |
| 10859_7_129 | LILRB1 | EXON | - | chr19: 54632718-54632738 | GUCGCUGGGGCCGACCACU | 10350 |
| 10859_7_132 | LILRB1 | EXON | - | chr19: 54632730-54632750 | GAUGUCCAGGGGUCGCUGG | 10351 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_7_133 | LILRB1 | EXON | - | chr19: 54632731-54632751 | GGAUGUCCAGGGGUCGCUG | 10352 |
| 10859_7_135 | LILRB1 | EXON | - | chr19: 54632732-54632752 | AGGAUGUCCAGGGGUCGCU | 10353 |
| 10859_7_137 | LILRB1 | EXON | - | chr19: 54632733-54632753 | CAGGAUGUCCAGGGGUCGC | 10354 |
| 10859_7_139 | LILRB1 | EXON | - | chr19: 54632740-54632760 | CUGCGAUCAGGAUGUCCAGG | 10355 |
| 10859_7_140 | LILRB1 | EXON | - | chr19: 54632741-54632761 | CCUGCGAUCAGGAUGUCCAG | 10356 |
| 10859_7_141 | LILRB1 | EXON | - | chr19: 54632742-54632762 | ACCUGCGAUCAGGAUGUCCA | 10357 |
| 10859_7_144 | LILRB1 | EXON | - | chr19: 54632743-54632763 | CACCUGCGAUCAGGAUGUCC | 10358 |
| 10859_7_146 | LILRB1 | EXON | - | chr19: 54632752-54632772 | UGGGCUCCUCACCUGCGAUC | 10359 |
| 10859_8_4 | LILRB1 | EXON | + | chr19: 54633022-54633042 | CUAUGACAGAGUCUCCCUCU | 10360 |
| 10859_8_7 | LILRB1 | EXON | + | chr19: 54633031-54633051 | AGUCUCCCUCUCGGUGCAGC | 10361 |
| 10859_8_8 | LILRB1 | EXON | + | chr19: 54633032-54633052 | GUCUCCCUCUCGGUGCAGCC | 10362 |
| 10859_8_9 | LILRB1 | EXON | + | chr19: 54633040-54633060 | CUCGGUGCAGCCGGGCCCCA | 10363 |
| 10859_8_10 | LILRB1 | EXON | + | chr19: 54633043-54633063 | GGUGCAGCCGGGCCCCACGG | 10364 |
| 10859_8_13 | LILRB1 | EXON | + | chr19: 54633050-54633070 | CCGGGCCCCACGGUGGCCUC | 10365 |
| 10859_8_17 | LILRB1 | EXON | + | chr19: 54633082-54633102 | GACCCUGCUGUGUCAGUCAC | 10366 |
| 10859_8_19 | LILRB1 | EXON | + | chr19: 54633083-54633103 | ACCCUGCUGUGUCAGUCACA | 10367 |
| 10859_8_21 | LILRB1 | EXON | + | chr19: 54633087-54633107 | UGCUGUGUCAGUCACAGGGA | 10368 |
| 10859_8_23 | LILRB1 | EXON | + | chr19: 54633112-54633132 | GCAAACUUCCUUCUGACCA | 10369 |
| 10859_8_26 | LILRB1 | EXON | + | chr19: 54633115-54633135 | AACUUCCUUCUGACCAAGG | 10370 |
| 10859_8_28 | LILRB1 | EXON | + | chr19: 54633116-54633136 | ACUUCCUUCUGACCAAGGA | 10371 |
| 10859_8_30 | LILRB1 | EXON | + | chr19: 54633117-54633137 | CUUUCCUUCUGACCAAGGAG | 10372 |
| 10859_8_31 | LILRB1 | EXON | + | chr19: 54633118-54633138 | UUUCCUUCUGACCAAGGAGG | 10373 |
| 10859_8_35 | LILRB1 | EXON | + | chr19: 54633135-54633155 | AGGGGGCAGCUGAUGACCCA | 10374 |
| 10859_8_36 | LILRB1 | EXON | + | chr19: 54633172-54633192 | GUACCAAUCUCAAAAAUACC | 10375 |
| 10859_8_39 | LILRB1 | EXON | + | chr19: 54633187-54633207 | AUACCAGGCUGAAUUCCCCA | 10376 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_8_40 | LILRB1 | EXON | + | chr19: 54633188-54633208 | UACCAGGCUGAAUUCCCCAU | 10377 |
| 10859_8_44 | LILRB1 | EXON | + | chr19: 54633211-54633231 | UCCUGUGACCUCAGCCCAUG | 10378 |
| 10859_8_46 | LILRB1 | EXON | + | chr19: 54633212-54633232 | CCUGUGACCUCAGCCCAUGC | 10379 |
| 10859_8_47 | LILRB1 | EXON | + | chr19: 54633213-54633233 | CUGUGACCUCAGCCCAUGCG | 10380 |
| 10859_8_48 | LILRB1 | EXON | + | chr19: 54633222-54633242 | CAGCCCAUGCGGGACCUAC | 10381 |
| 10859_8_49 | LILRB1 | EXON | + | chr19: 54633230-54633250 | GCGGGGACCUACAGGUGCUA | 10382 |
| 10859_8_52 | LILRB1 | EXON | + | chr19: 54633280-54633300 | GACUCACCCAGUGACCCCC | 10383 |
| 10859_8_54 | LILRB1 | EXON | + | chr19: 54633289-54633309 | CAGUGACCCCUGGAGCUCG | 10384 |
| 10859_8_55 | LILRB1 | EXON | + | chr19: 54633296-54633316 | CCCCUGGAGCUCGUGGUCUC | 10385 |
| 10859_8_58 | LILRB1 | EXON | + | chr19: 54633299-54633319 | CUGGAGCUCGUGGUCUCAGG | 10386 |
| 10859_8_59 | LILRB1 | EXON | + | chr19: 54633300-54633320 | UGGAGCUCGUGGUCUCAGGU | 10387 |
| 10859_8_61 | LILRB1 | EXON | + | chr19: 54633301-54633321 | GGAGCUCGUGGUCUCAGGUG | 10388 |
| 10859_8_62 | LILRB1 | EXON | + | chr19: 54633302-54633322 | GAGCUCGUGGUCUCAGGUGG | 10389 |
| 10859_8_63 | LILRB1 | EXON | - | chr19: 54632998-54633018 | GUCCUGGAGAGAAGAAGGAU | 10390 |
| 10859_8_64 | LILRB1 | EXON | - | chr19: 54632999-54633019 | UGUCCUGGAGAGAAGAAGGA | 10391 |
| 10859_8_66 | LILRB1 | EXON | - | chr19: 54633003-54633023 | GAACUGUCCUGGAGAGAAGA | 10392 |
| 10859_8_74 | LILRB1 | EXON | - | chr19: 54633014-54633034 | ACUCUGUCAUAGAACUGUCC | 10393 |
| 10859_8_79 | LILRB1 | EXON | - | chr19: 54633039-54633059 | GGGGCCCGGCUGCACCGAGA | 10394 |
| 10859_8_81 | LILRB1 | EXON | - | chr19: 54633040-54633060 | UGGGGCCCGGCUGCACCGAG | 10395 |
| 10859_8_86 | LILRB1 | EXON | - | chr19: 54633053-54633073 | CCUGAGGCCACCGUGGGGCC | 10396 |
| 10859_8_87 | LILRB1 | EXON | - | chr19: 54633058-54633078 | UCUCUCCUGAGGCCACCGUG | 10397 |
| 10859_8_88 | LILRB1 | EXON | - | chr19: 54633059-54633079 | UUCUCUCCUGAGGCCACCGU | 10398 |
| 10859_8_90 | LILRB1 | EXON | - | chr19: 54633060-54633080 | GUUCUCUCCUGAGGCCACCG | 10399 |
| 10859_8_92 | LILRB1 | EXON | - | chr19: 54633069-54633089 | CAGGGUCACGUUCUCUCCUG | 10400 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_8_94 | LILRB1 | EXON | - | chr19: 54633087-54633107 | UCCCUGUGACUGACACAGCA | 10401 |
| 10859_8_95 | LILRB1 | EXON | - | chr19: 54633088-54633108 | AUCCCUGUGACUGACACAGC | 10402 |
| 10859_8_100 | LILRB1 | EXON | - | chr19: 54633124-54633144 | CUGCCCCUCCUUGGUCAGA | 10403 |
| 10859_8_105 | LILRB1 | EXON | - | chr19: 54633132-54633152 | GUCAUCAGCUGCCCCUCCU | 10404 |
| 10859_8_109 | LILRB1 | EXON | - | chr19: 54633154-54633174 | ACGUUGAUCUUAGACGCCAU | 10405 |
| 10859_8_110 | LILRB1 | EXON | - | chr19: 54633155-54633175 | UACGUUGAUCUUAGACGCCA | 10406 |
| 10859_8_117 | LILRB1 | EXON | - | chr19: 54633178-54633198 | CAGCCUGGUAUUUUGAGAU | 10407 |
| 10859_8_119 | LILRB1 | EXON | - | chr19: 54633193-54633213 | GACCCAUGGGGAAUUCAGCC | 10408 |
| 10859_8_120 | LILRB1 | EXON | - | chr19: 54633205-54633225 | CUGAGGUCACAGGACCCAUG | 10409 |
| 10859_8_123 | LILRB1 | EXON | - | chr19: 54633206-54633226 | GCUGAGGUCACAGGACCAU | 10410 |
| 10859_8_125 | LILRB1 | EXON | - | chr19: 54633207-54633227 | GGCUGAGGUCACAGGACCA | 10411 |
| 10859_8_127 | LILRB1 | EXON | - | chr19: 54633215-54633235 | CCCGCAUGGGCUGAGGUCAC | 10412 |
| 10859_8_129 | LILRB1 | EXON | - | chr19: 54633222-54633242 | GUAGGUCCCGCAUGGGCUG | 10413 |
| 10859_8_131 | LILRB1 | EXON | - | chr19: 54633228-54633248 | GCACCUGUAGGUCCCCGCAU | 10414 |
| 10859_8_132 | LILRB1 | EXON | - | chr19: 54633229-54633249 | AGCACCUGUAGGUCCCCGCA | 10415 |
| 10859_8_134 | LILRB1 | EXON | - | chr19: 54633240-54633260 | CUGUGAGCCGUAGCACCUGU | 10416 |
| 10859_8_139 | LILRB1 | EXON | - | chr19: 54633267-54633287 | GUGAGUCAGCAGGUAGGGUU | 10417 |
| 10859_8_141 | LILRB1 | EXON | - | chr19: 54633272-54633292 | CUGGGGUGAGUCAGCAGGUA | 10418 |
| 10859_8_142 | LILRB1 | EXON | - | chr19: 54633273-54633293 | ACUGGGGUGAGUCAGCAGGU | 10419 |
| 10859_8_144 | LILRB1 | EXON | - | chr19: 54633277-54633297 | GGUCACUGGGGUGAGUCAGC | 10420 |
| 10859_8_146 | LILRB1 | EXON | - | chr19: 54633289-54633309 | CGAGCUCCAGGGGUCACUG | 10421 |
| 10859_8_147 | LILRB1 | EXON | - | chr19: 54633290-54633310 | ACGAGCUCCAGGGGUCACU | 10422 |
| 10859_8_149 | LILRB1 | EXON | - | chr19: 54633291-54633311 | CACGAGCUCCAGGGGGUCAC | 10423 |
| 10859_8_151 | LILRB1 | EXON | - | chr19: 54633298-54633318 | CUGAGACCACGAGCUCCAGG | 10424 |
| 10859_8_152 | LILRB1 | EXON | - | chr19: 54633299-54633319 | CCUGAGACCACGAGCUCCAG | 10425 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_8_153 | LILRB1 | EXON | - | chr19: 54633300-54633320 | ACCUGAGACCACGAGCUCCA | 10426 |
| 10859_8_156 | LILRB1 | EXON | - | chr19: 54633301-54633321 | CACCUGAGACCACGAGCUCC | 10427 |
| 10859_9_2 | LILRB1 | EXON | + | chr19: 54633624-54633644 | UUCUUUUACCCAGGACCGUC | 10428 |
| 10859_9_5 | LILRB1 | EXON | + | chr19: 54633625-54633645 | UCUUUUACCCAGGACCGUCU | 10429 |
| 10859_9_6 | LILRB1 | EXON | + | chr19: 54633626-54633646 | CUUUUACCCAGGACCGUCUG | 10430 |
| 10859_9_7 | LILRB1 | EXON | + | chr19: 54633627-54633647 | UUUUACCCAGGACCGUCUGG | 10431 |
| 10859_9_12 | LILRB1 | EXON | + | chr19: 54633648-54633668 | GGCCCAGCUCCCCGACAAC | 10432 |
| 10859_9_13 | LILRB1 | EXON | + | chr19: 54633666-54633686 | ACAGGCCCCACCUCCACAUC | 10433 |
| 10859_9_16 | LILRB1 | EXON | + | chr19: 54633679-54633699 | CCACAUCUGGUGAGUCCCUG | 10434 |
| 10859_9_17 | LILRB1 | EXON | - | chr19: 54633620-54633640 | GUCCUGGGUAAAAGAAUGAG | 10435 |
| 10859_9_21 | LILRB1 | EXON | - | chr19: 54633635-54633655 | UGGGGCCCCAGACGGUCCU | 10436 |
| 10859_9_22 | LILRB1 | EXON | - | chr19: 54633636-54633656 | CUGGGGCCCCAGACGGUCC | 10437 |
| 10859_9_25 | LILRB1 | EXON | - | chr19: 54633642-54633662 | GGGGAGCUGGGGCCCCAGA | 10438 |
| 10859_9_26 | LILRB1 | EXON | - | chr19: 54633653-54633673 | GGCCUGUUGUCGGGAGCUG | 10439 |
| 10859_9_27 | LILRB1 | EXON | - | chr19: 54633654-54633674 | GGGCCUGUUGUCGGGAGCU | 10440 |
| 10859_9_28 | LILRB1 | EXON | - | chr19: 54633655-54633675 | GGGGCCUGUUGUCGGGAGC | 10441 |
| 10859_9_31 | LILRB1 | EXON | - | chr19: 54633661-54633681 | GGAGGUGGGGCCUGUUGUCG | 10442 |
| 10859_9_34 | LILRB1 | EXON | - | chr19: 54633662-54633682 | UGGAGGUGGGGCCUGUUGUC | 10443 |
| 10859_9_36 | LILRB1 | EXON | - | chr19: 54633663-54633683 | GUGGAGGUGGGGCCUGUUGU | 10444 |
| 10859_9_38 | LILRB1 | EXON | - | chr19: 54633674-54633694 | ACUCACCAGAUGUGGAGGUG | 10445 |
| 10859_9_39 | LILRB1 | EXON | - | chr19: 54633675-54633695 | GACUCACCAGAUGUGGAGGU | 10446 |
| 10859_9_41 | LILRB1 | EXON | - | chr19: 54633676-54633696 | GGACUCACCAGAUGUGGAGG | 10447 |
| 10859_9_43 | LILRB1 | EXON | - | chr19: 54633679-54633699 | CAGGGACUCACCAGAUGUGG | 10448 |
| 10859_9_44 | LILRB1 | EXON | - | chr19: 54633682-54633702 | CCUCAGGGACUCACCAGAUG | 10449 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_10_1 | LILRB1 | EXON | + | chr19: 54633951-54633971 | CCUCCCCGUCCUGACCCAGC | 10450 |
| 10859_10_4 | LILRB1 | EXON | + | chr19: 54633959-54633979 | UCCUGACCCAGCAGGCCCUG | 10451 |
| 10859_10_6 | LILRB1 | EXON | + | chr19: 54633981-54634001 | GACCAGCCCCUCACCCCCAC | 10452 |
| 10859_10_7 | LILRB1 | EXON | + | chr19: 54633982-54634002 | ACCAGCCCCUCACCCCCACC | 10453 |
| 10859_10_9 | LILRB1 | EXON | + | chr19: 54633986-54634006 | GCCCCUCACCCCCACCGGGU | 10454 |
| 10859_10_11 | LILRB1 | EXON | + | chr19: 54633999-54634019 | ACCGGGUCGGAUCCCCAGAG | 10455 |
| 10859_10_14 | LILRB1 | EXON | + | chr19: 54634009-54634029 | AUCCCCAGAGUGGUGAGUGA | 10456 |
| 10859_10_15 | LILRB1 | EXON | + | chr19: 54634010-54634030 | UCCCCAGAGUGGUGAGUGAC | 10457 |
| 10859_10_18 | LILRB1 | EXON | + | chr19: 54634020-54634040 | GGUGAGUGACGGGCUCUGAG | 10458 |
| 10859_10_21 | LILRB1 | EXON | + | chr19: 54634021-54634041 | GUGAGUGACGGGCUCUGAGU | 10459 |
| 10859_10_22 | LILRB1 | EXON | + | chr19: 54634024-54634044 | AGUGACGGGCUCUGAGUGGG | 10460 |
| 10859_10_24 | LILRB1 | EXON | + | chr19: 54634027-54634047 | GACGGGCUCUGAGUGGGAGG | 10461 |
| 10859_10_25 | LILRB1 | EXON | + | chr19: 54634028-54634048 | ACGGGCUCUGAGUGGGAGGU | 10462 |
| 10859_10_27 | LILRB1 | EXON | + | chr19: 54634032-54634052 | GCUCUGAGUGGGAGGUGGGC | 10463 |
| 10859_10_28 | LILRB1 | EXON | + | chr19: 54634033-54634053 | CUCUGAGUGGGAGGUGGGCA | 10464 |
| 10859_10_29 | LILRB1 | EXON | - | chr19: 54633954-54633974 | CCUGCUGGGUCAGGACGGGG | 10465 |
| 10859_10_30 | LILRB1 | EXON | - | chr19: 54633957-54633977 | GGGCCUGCUGGGUCAGGACG | 10466 |
| 10859_10_32 | LILRB1 | EXON | - | chr19: 54633958-54633978 | AGGGCCUGCUGGGUCAGGAC | 10467 |
| 10859_10_34 | LILRB1 | EXON | - | chr19: 54633959-54633979 | CAGGGCCUGCUGGGUCAGGA | 10468 |
| 10859_10_37 | LILRB1 | EXON | - | chr19: 54633963-54633983 | UCCUCAGGGCCUGCUGGGUC | 10469 |
| 10859_10_39 | LILRB1 | EXON | - | chr19: 54633968-54633988 | GCUGGUCCUCAGGGCCUGCU | 10470 |
| 10859_10_40 | LILRB1 | EXON | - | chr19: 54633969-54633989 | GGCUGGUCCUCAGGGCCUGC | 10471 |
| 10859_10_42 | LILRB1 | EXON | - | chr19: 54633977-54633997 | GGGUGAGGGGCUGGUCCUCA | 10472 |
| 10859_10_43 | LILRB1 | EXON | - | chr19: 54633978-54633998 | GGGGUGAGGGGCUGGUCCUC | 10473 |
| 10859_10_45 | LILRB1 | EXON | - | chr19: 54633986-54634006 | ACCCGGUGGGGGUGAGGGGC | 10474 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_10_46 | LILRB1 | EXON | - | chr19: 54633990-54634010 | UCCGACCCGGUGGGGGUGAG | 10475 |
| 10859_10_47 | LILRB1 | EXON | - | chr19: 54633991-54634011 | AUCCGACCCGGUGGGGGUGA | 10476 |
| 10859_10_48 | LILRB1 | EXON | - | chr19: 54633992-54634012 | GAUCCGACCCGGUGGGGGUG | 10477 |
| 10859_10_52 | LILRB1 | EXON | - | chr19: 54633997-54634017 | CUGGGGAUCCGACCCGGUGG | 10478 |
| 10859_10_53 | LILRB1 | EXON | - | chr: 54633998-54634018 | UCUGGGGAUCCGACCCGGUG | 10479 |
| 10859_10_55 | LILRB1 | EXON | - | chr19: 54633999-54634019 | CUCUGGGGAUCCGACCCGGU | 10480 |
| 10859_10_57 | LILRB1 | EXON | - | chr: 54634000-54634020 | ACUCUGGGGAUCCGACCCGG | 10481 |
| 10859_10_59 | LILRB1 | EXON | - | chr: 54634003-54634023 | ACCACUCUGGGGAUCCGACC | 10482 |
| 10859_10_60 | LILRB1 | EXON | - | chr: 54634014-54634034 | GCCCGUCACUCACCACUCUG | 10483 |
| 10859_10_62 | LILRB1 | EXON | - | chr: 54634015-54634035 | AGCCCGUCACUCACCACUCU | 10484 |
| 10859_10_64 | LILRB1 | EXON | - | chr: 54634016-54634036 | GAGCCCGUCACUCACCACUC | 10485 |
| 10859_10_67 | LILRB1 | EXON | - | chr: 54634060-54634080 | CUUGGGUGGGACGGAGGGC | 10486 |
| 10859_11_2 | LILRB1 | EXON | + | chr: 54634623-54634643 | ACAUCAUCGUGCUCAAGGUC | 10487 |
| 10859_11_4 | LILRB1 | EXON | + | chr: 54634624-54634644 | CAUCAUCGUGCUCAAGGUCU | 10488 |
| 10859_11_6 | LILRB1 | EXON | + | chr: 54634628-54634648 | AUCGUGCUCAAGGUCUGGGA | 10489 |
| 10859_11_9 | LILRB1 | EXON | + | chr: 54634635-54634655 | UCAAGGUCUGGGAAGGCACC | 10490 |
| 10859_11_11 | LILRB1 | EXON | + | chr: 54634636-54634656 | CAAGGUCUGGGAAGGCACCU | 10491 |
| 10859_11_12 | LILRB1 | EXON | + | chr: 54634637-54634657 | AAGGUCUGGGAAGGCACCUG | 10492 |
| 10859_11_13 | LILRB1 | EXON | + | chr: 54634638-54634658 | AGGUCUGGGAAGGCACCUGG | 10493 |
| 10859_11_14 | LILRB1 | EXON | + | chr: 54634648-54634668 | AGGCACCUGGGGUUGUGAU | 10494 |
| 10859_11_15 | LILRB1 | EXON | + | chr: 54634656-54634676 | GGGGGUUGUGAUCGGCAUCU | 10495 |
| 10859_11_16 | LILRB1 | EXON | + | chr: 54634659-54634679 | GGUUGUGAUCGGCAUCUUGG | 10496 |
| 10859_11_20 | LILRB1 | EXON | + | chr: 54634722-54634742 | CAUCCUCCGACAUCGACGUC | 10497 |
| 10859_11_21 | LILRB1 | EXON | + | chr: 54634723-54634743 | AUCCUCCGACAUCGACGUCA | 10498 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_11_23 | LILRB1 | EXON | + | chr19: 54634733-54634753 | AUCGACGUCAGGGCAAACAC | 10499 |
| 10859_11_28 | LILRB1 | EXON | + | chr19: 54634749-54634769 | ACACUGGACAUCGAGUGAGU | 10500 |
| 10859_11_29 | LILRB1 | EXON | + | chr19: 54634750-54634770 | CACUGGACAUCGAGUGAGUA | 10501 |
| 10859_11_32 | LILRB1 | EXON | + | chr19: 54634755-54634775 | GACAUCGAGUGAGUAGGGAA | 10502 |
| 10859_11_35 | LILRB1 | EXON | + | chr19: 54634756-54634776 | ACAUCGAGUGAGUAGGGAAU | 10503 |
| 10859_11_36 | LILRB1 | EXON | + | chr19: 54634757-54634777 | CAUCGAGUGAGUAGGGAAUG | 10504 |
| 10859_11_38 | LILRB1 | EXON | + | chr19: 54634758-54634778 | AUCGAGUGAGUAGGGAAUGG | 10505 |
| 10859_11_40 | LILRB1 | EXON | + | chr19: 54634759-54634779 | UCGAGUGAGUAGGGAAUGGG | 10506 |
| 10859_11_43 | LILRB1 | EXON | - | chr19: 54634656-54634676 | AGAUGCCGAUCACAACCCCC | 10507 |
| 10859_11_44 | LILRB1 | EXON | - | chr19: 54634685-54634705 | CUCCUCCUCCAGUAGGAUGA | 10508 |
| 10859_11_45 | LILRB1 | EXON | - | chr19: 54634692-54634712 | CCUCCUCCUCCUCCUCCAGU | 10509 |
| 10859_12_4 | LILRB1 | EXON | + | chr19: 54635092-54635112 | UCUUCCCCAGCCCAGAGAA | 10510 |
| 10859_12_8 | LILRB1 | EXON | + | chr19: 54635114-54635134 | GCUGAUUUCCAACAUCCUGC | 10511 |
| 10859_12_10 | LILRB1 | EXON | + | chr19: 54635115-54635135 | CUGAUUUCCAACAUCCUGCA | 10512 |
| 10859_12_11 | LILRB1 | EXON | + | chr19: 54635116-54635136 | UGAUUUCCAACAUCCUGCAG | 10513 |
| 10859_12_15 | LILRB1 | EXON | + | chr19: 54635122-54635142 | CCAACAUCCUGCAGGGGCUG | 10514 |
| 10859_12_16 | LILRB1 | EXON | + | chr19: 54635123-54635143 | CAACAUCCUGCAGGGGCUGU | 10515 |
| 10859_12_18 | LILRB1 | EXON | + | chr19: 54635124-54635144 | AACAUCCUGCAGGGGCUGUG | 10516 |
| 10859_12_21 | LILRB1 | EXON | + | chr19: 54635144-54635164 | GGGCCAGAGCCCACAGACAG | 10517 |
| 10859_12_24 | LILRB1 | EXON | + | chr19: 54635154-54635174 | CCACAGACAGAGGCCUGCAG | 10518 |
| 10859_12_25 | LILRB1 | EXON | + | chr19: 54635157-54635177 | CAGACAGAGGCCUGCAGUGG | 10519 |
| 10859_12_30 | LILRB1 | EXON | - | chr19: 54635092-54635112 | UUCUCUGGGCUGGGGGAAGA | 10520 |
| 10859_12_35 | LILRB1 | EXON | - | chr19: 54635099-54635119 | UCAGCCUUUCUCUGGGCUGG | 10521 |
| 10859_12_37 | LILRB1 | EXON | - | chr19: 54635100-54635120 | AUCAGCCUUUCUCUGGGCUG | 10522 |
| 10859_12_40 | LILRB1 | EXON | - | chr19: 54635101-54635121 | AAUCAGCCUUUCUCUGGGCU | 10523 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_12_42 | LILRB1 | EXON | - | chr19: 54635102-54635122 | AAAUCAGCCUUUCUCUGGGC | 10524 |
| 10859_12_44 | LILRB1 | EXON | - | chr19: 54635106-54635126 | UUGGAAAUCAGCCUUUCUCU | 10525 |
| 10859_12_45 | LILRB1 | EXON | - | chr19: 54635107-54635127 | GUUGGAAAUCAGCCUUUCUC | 10526 |
| 10859_12_48 | LILRB1 | EXON | - | chr19: 54635125-54635145 | CCACAGCCCCUGCAGGAUGU | 10527 |
| 10859_12_50 | LILRB1 | EXON | - | chr19: 54635132-54635152 | UCUGGCCCCACAGCCCCUGC | 10528 |
| 10859_12_52 | LILRB1 | EXON | - | chr19: 54635150-54635170 | AGGCCUCUGUCUGUGGGCUC | 10529 |
| 10859_12_53 | LILRB1 | EXON | - | chr19: 54635156-54635176 | CACUGCAGGCCUCUGUCUGU | 10530 |
| 10859_12_55 | LILRB1 | EXON | - | chr19: 54635157-54635177 | CCACUGCAGGCCUCUGUCUG | 10531 |
| 10859_12_58 | LILRB1 | EXON | - | chr19: 54635170-54635190 | GGCAGAAUUACCUCCACUGC | 10532 |
| 10859_13_5 | LILRB1 | EXON | + | chr19: 54635261-54635281 | CAGCCCAGCUGCCGAUGCCC | 10533 |
| 10859_13_13 | LILRB1 | EXON | + | chr19: 54635285-54635305 | AGAAAACCUCUGUGAGUGAG | 10534 |
| 10859_13_15 | LILRB1 | EXON | + | chr19: 54635291-54635311 | CCUCUGUGAGUGAGAGGAAG | 10535 |
| 10859_13_16 | LILRB1 | EXON | - | chr19: 54635245-54635265 | GCUGGACCUGGGGAAGAAU | 10536 |
| 10859_13_19 | LILRB1 | EXON | - | chr19: 54635246-54635266 | GGCUGGACCUGGGGAAGAA | 10537 |
| 10859_13_23 | LILRB1 | EXON | - | chr19: 54635254-54635274 | GGCAGCUGGGCUGGACCUGG | 10538 |
| 10859_13_25 | LILRB1 | EXON | - | chr19: 54635255-54635275 | CGGCAGCUGGGCUGGACCUG | 10539 |
| 10859_13_27 | LILRB1 | EXON | - | chr19: 54635256-54635276 | UCGGCAGCUGGGCUGGACCU | 10540 |
| 10859_13_28 | LILRB1 | EXON | - | chr19: 54635257-54635277 | AUCGGCAGCUGGGCUGGACC | 10541 |
| 10859_13_33 | LILRB1 | EXON | - | chr19: 54635263-54635283 | CUGGGCAUCGGCAGCUGGGC | 10542 |
| 10859_13_37 | LILRB1 | EXON | - | chr19: 54635267-54635287 | CUUCCUGGGCAUCGGCAGCU | 10543 |
| 10859_13_38 | LILRB1 | EXON | - | chr19: 54635268-54635288 | UCUUCCUGGGCAUCGGCAGC | 10544 |
| 10859_13_40 | LILRB1 | EXON | - | chr19: 54635275-54635295 | GAGGUUUUCUUCCUGGGCAU | 10545 |
| 10859_13_41 | LILRB1 | EXON | - | chr19: 54635281-54635301 | CUCACAGAGGUUUUCUUCCU | 10546 |
| 10859_13_42 | LILRB1 | EXON | - | chr19: 54635282-54635302 | ACUCACAGAGGUUUUCUUCC | 10547 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_13_45 | LILRB1 | EXON | - | chr19: 54635294-54635314 | CCUCUUCCUCUCACUCACAG | 10548 |
| 10859_14_5 | LILRB1 | EXON | + | chr19: 54635563-54635583 | CGUGAAGCACACACAGCCUG | 10549 |
| 10859_14_7 | LILRB1 | EXON | + | chr19: 54635567-54635587 | AAGCACACACAGCCUGAGGA | 10550 |
| 10859_14_9 | LILRB1 | EXON | + | chr19: 54635568-54635588 | AGCACACACAGCCUGAGGAU | 10551 |
| 10859_14_10 | LILRB1 | EXON | + | chr19: 54635569-54635589 | GCACACACAGCCUGAGGAUG | 10552 |
| 10859_14_12 | LILRB1 | EXON | + | chr19: 54635572-54635592 | CACACAGCCUGAGGAUGGGG | 10553 |
| 10859_14_15 | LILRB1 | EXON | + | chr19: 54635578-54635598 | GCCUGAGGAUGGGGUGGAGA | 10554 |
| 10859_14_17 | LILRB1 | EXON | + | chr19: 54635586-54635606 | AUGGGGUGGAGAUGGACACU | 10555 |
| 10859_14_18 | LILRB1 | EXON | + | chr19: 54635587-54635607 | UGGGGUGGAGAUGGACACUC | 10556 |
| 10859_14_20 | LILRB1 | EXON | - | chr19: 54635539-54635559 | CAUCUGCUGGGGCAGAGCAA | 10557 |
| 10859_14_21 | LILRB1 | EXON | - | chr19: 54635540-54635560 | GCAUCUGCUGGGGCAGAGCA | 10558 |
| 10859_14_25 | LILRB1 | EXON | - | chr19: 54635550-54635570 | CUUCACGGCAGCAUCUGCUG | 10559 |
| 10859_14_26 | LILRB1 | EXON | - | chr19: 54635551-54635571 | GCUUCACGGCAGCAUCUGCU | 10560 |
| 10859_14_28 | LILRB1 | EXON | - | chr19: 54635552-54635572 | UGCUUCACGGCAGCAUCUGC | 10561 |
| 10859_14_30 | LILRB1 | EXON | - | chr19: 54635565-54635585 | CUCAGGCUGUGUGUGCUUCA | 10562 |
| 10859_14_31 | LILRB1 | EXON | - | chr19: 54635582-54635602 | UCCAUCUCCACCCCAUCCUC | 10563 |
| 10859_15_3 | LILRB1 | EXON | + | chr19: 54636498-54636518 | CCCACACGAUGAAGACCCCC | 10564 |
| 10859_15_5 | LILRB1 | EXON | + | chr19: 54636516-54636536 | CCAGGCAGUGACGUAUGCCG | 10565 |
| 10859_15_8 | LILRB1 | EXON | + | chr19: 54636536-54636556 | AGGUGAAACACUCCAGACCU | 10566 |
| 10859_15_13 | LILRB1 | EXON | + | chr19: 54636546-54636566 | CUCCAGACCUAGGAGAGAAA | 10567 |
| 10859_15_15 | LILRB1 | EXON | + | chr19: 54636571-54636591 | UCUCCUCCUUCCCCACUGUC | 10568 |
| 10859_15_17 | LILRB1 | EXON | + | chr19: 54636572-54636592 | CUCCUCCUUCCCCACUGUCU | 10569 |
| 10859_15_20 | LILRB1 | EXON | + | chr19: 54636573-54636593 | UCCUCCUUCCCCACUGUCUG | 10570 |
| 10859_15_23 | LILRB1 | EXON | + | chr19: 54636582-54636602 | CCCACUGUCUGGGGAAUUCC | 10571 |
| 10859_15_25 | LILRB1 | EXON | + | chr19: 54636591-54636611 | UGGGGAAUUCCUGGACACAA | 10572 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_15_26 | LILRB1 | EXON | + | chr19: 54636600-54636620 | CCUGGACACAAAGGACAGAC | 10573 |
| 10859_15_29 | LILRB1 | EXON | + | chr19: 54636603-54636623 | GGACACAAAGGACAGACAGG | 10574 |
| 10859_15_33 | LILRB1 | EXON | + | chr19: 54636609-54636629 | AAAGGACAGACAGGCGGAAG | 10575 |
| 10859_15_34 | LILRB1 | EXON | + | chr19: 54636614-54636634 | ACAGACAGGCGGAAGAGGAC | 10576 |
| 10859_15_36 | LILRB1 | EXON | + | chr19: 54636621-54636641 | GGCGGAAGAGGACAGGCAGA | 10577 |
| 10859_15_38 | LILRB1 | EXON | + | chr19: 54636630-54636650 | GGACAGGCAGAUGGACACUG | 10578 |
| 10859_15_40 | LILRB1 | EXON | - | chr19: 54636476-54636496 | CUGCUGGAGAGACAGUGG | 10579 |
| 10859_15_41 | LILRB1 | EXON | - | chr19: 54636479-54636499 | GCUCUGCUGGAGAGAGACAG | 10580 |
| 10859_15_46 | LILRB1 | EXON | - | chr19: 54636492-54636512 | CUUCAUCGUGUGGGCUCUGC | 10581 |
| 10859_15_48 | LILRB1 | EXON | - | chr19: 54636501-54636521 | CCUGGGGUCUUCAUCGUGU | 10582 |
| 10859_15_49 | LILRB1 | EXON | - | chr19: 54636502-54636522 | GCCUGGGGGUCUUCAUCGUG | 10583 |
| 10859_15_51 | LILRB1 | EXON | - | chr19: 54636516-54636536 | CGGCAUACGUCACUGCCUGG | 10584 |
| 10859_15_52 | LILRB1 | EXON | - | chr19: 54636517-54636537 | UCGGCAUACGUCACUGCCUG | 10585 |
| 10859_15_55 | LILRB1 | EXON | - | chr19: 54636518-54636538 | CUCGGCAUACGUCACUGCCU | 10586 |
| 10859_15_58 | LILRB1 | EXON | - | chr19: 54636519-54636539 | CCUCGGCAUACGUCACUGCC | 10587 |
| 10859_15_60 | LILRB1 | EXON | - | chr19: 54636536-54636556 | AGGUCUGGAGUGUUUCACCU | 10588 |
| 10859_15_63 | LILRB1 | EXON | - | chr19: 54636551-54636571 | GGCCAUUUCUCUCCUAGGUC | 10589 |
| 10859_15_66 | LILRB1 | EXON | - | chr19: 54636556-54636576 | GGAGAGGCCAUUUCUCUCCU | 10590 |
| 10859_15_68 | LILRB1 | EXON | - | chr19: 54636572-54636592 | AGACAGUGGGGAAGGAGGAG | 10591 |
| 10859_15_70 | LILRB1 | EXON | - | chr19: 54636577-54636597 | UCCCCAGACAGUGGGGAAGG | 10592 |
| 10859_15_74 | LILRB1 | EXON | - | chr19: 54636580-54636600 | AAUUCCCCAGACAGUGGGGA | 10593 |
| 10859_15_76 | LILRB1 | EXON | - | chr19: 54636584-54636604 | CAGGAAUUCCCCAGACAGUG | 10594 |
| 10859_15_80 | LILRB1 | EXON | - | chr19: 54636585-54636605 | CCAGGAAUUCCCCAGACAGU | 10595 |
| 10859_15_82 | LILRB1 | EXON | - | chr19: 54636586-54636606 | UCCAGGAAUUCCCCAGACAG | 10596 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_15_87 | LILRB1 | EXON | - | chr19: 54636603-54636623 | CCUGUCUGUCCUUUGUGUCC | 10597 |
| 10859_16_3 | LILRB1 | EXON | + | chr19: 54636733-54636753 | UGCUGCAUCUGAAGCCCCCC | 10598 |
| 10859_16_6 | LILRB1 | EXON | + | chr19: 54636774-54636794 | UGCACAGCUUGACCCUCAGA | 10599 |
| 10859_16_7 | LILRB1 | EXON | + | chr19: 54636775-54636795 | GCACAGCUUGACCCUCAGAC | 10600 |
| 10859_16_9 | LILRB1 | EXON | + | chr19: 54636778-54636798 | CAGCUUGACCCUCAGACGGG | 10601 |
| 10859_16_14 | LILRB1 | EXON | + | chr19: 54636802-54636822 | AACUGAGCCUCCUCCAUCCC | 10602 |
| 10859_16_16 | LILRB1 | EXON | + | chr19: 54636806-54636826 | GAGCCUCCUCCAUCCCAGGA | 10603 |
| 10859_16_17 | LILRB1 | EXON | + | chr19: 54636807-54636827 | AGCCUCCUCCAUCCCAGGAA | 10604 |
| 10859_16_18 | LILRB1 | EXON | + | chr19: 54636844-54636864 | GCCCAGCAUCUACGCCACUC | 10605 |
| 10859_16_21 | LILRB1 | EXON | + | chr19: 54636861-54636881 | CUCUGGCCAUCCACUAGCCC | 10606 |
| 10859_16_22 | LILRB1 | EXON | + | chr19: 54636862-54636882 | UCUGGCCAUCCACUAGCCCA | 10607 |
| 10859_16_25 | LILRB1 | EXON | + | chr19: 54636863-54636883 | CUGGCCAUCCACUAGCCCAG | 10608 |
| 10859_16_27 | LILRB1 | EXON | + | chr19: 54636864-54636884 | UGGCCAUCCACUAGCCCAGG | 10609 |
| 10859_16_28 | LILRB1 | EXON | + | chr19: 54636865-54636885 | GGCCAUCCACUAGCCCAGGG | 10610 |
| 10859_16_30 | LILRB1 | EXON | + | chr19: 54636866-54636886 | GCCAUCCACUAGCCCAGGGG | 10611 |
| 10859_16_32 | LILRB1 | EXON | + | chr19: 54636888-54636908 | GACGCAGACCCCACACUCCA | 10612 |
| 10859_16_35 | LILRB1 | EXON | + | chr19: 54636895-54636915 | ACCCCACACUCCAUGGAGUC | 10613 |
| 10859_16_38 | LILRB1 | EXON | + | chr19: 54636904-54636924 | UCCAUGGAGUCUGGAAUGCA | 10614 |
| 10859_16_40 | LILRB1 | EXON | + | chr19: 54636905-54636925 | CCAUGGAGUCUGGAAUGCAU | 10615 |
| 10859_16_43 | LILRB1 | EXON | + | chr19: 54636922-54636942 | CAUGGGAGCUGCCCCCCCAG | 10616 |
| 10859_16_45 | LILRB1 | EXON | + | chr19: 54636932-54636952 | GCCCCCCAGUGGACACCAU | 10617 |
| 10859_16_47 | LILRB1 | EXON | + | chr19: 54636948-54636968 | CCAUUGGACCCCACCCAGCC | 10618 |
| 10859_16_50 | LILRB1 | EXON | + | chr19: 54636960-54636980 | ACCCAGCCUGGAUCUACCCC | 10619 |
| 10859_16_54 | LILRB1 | EXON | + | chr19: 54636969-54636989 | GGAUCUACCCCAGGAGACUC | 10620 |
| 10859_16_55 | LILRB1 | EXON | + | chr19: 54636970-54636990 | GAUCUACCCCAGGAGACUCU | 10621 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_16_58 | LILRB1 | EXON | + | chr19: 54636980-54637000 | AGGAGACUCUGGGAACUUUU | 10622 |
| 10859_16_60 | LILRB1 | EXON | + | chr19: 54636981-54637001 | GGAGACUCUGGGAACUUUUA | 10623 |
| 10859_16_61 | LILRB1 | EXON | + | chr19: 54636982-54637002 | GAGACUCUGGGAACUUUUAG | 10624 |
| 10859_16_70 | LILRB1 | EXON | - | chr19: 54636722-54636742 | GAUGCAGCAGCCUGCAGCGG | 10625 |
| 10859_16_72 | LILRB1 | EXON | - | chr19: 54636723-54636743 | AGAUGCAGCAGCCUGCAGCG | 10626 |
| 10859_16_74 | LILRB1 | EXON | - | chr19: 54636724-54636744 | CAGAUGCAGCAGCCUGCAGC | 10627 |
| 10859_16_75 | LILRB1 | EXON | - | chr19: 54636725-54636745 | UCAGAUGCAGCAGCCUGCAG | 10628 |
| 10859_16_78 | LILRB1 | EXON | - | chr19: 54636750-54636770 | GGCGUAGGUCACAUCCUGGG | 10629 |
| 10859_16_79 | LILRB1 | EXON | - | chr19: 54636751-54636771 | GGGCGUAGGUCACAUCCUGG | 10630 |
| 10859_16_81 | LILRB1 | EXON | - | chr19: 54636752-54636772 | UGGGCGUAGGUCACAUCCUG | 10631 |
| 10859_16_83 | LILRB1 | EXON | - | chr19: 54636753-54636773 | CUGGGCGUAGGUCACAUCCU | 10632 |
| 10859_16_84 | LILRB1 | EXON | - | chr19: 54636754-54636774 | GCUGGGCGUAGGUCACAUCC | 10633 |
| 10859_16_87 | LILRB1 | EXON | - | chr19: 54636765-54636785 | CAAGCUGUGCAGCUGGGCGU | 10634 |
| 10859_16_88 | LILRB1 | EXON | - | chr19: 54636771-54636791 | GAGGGUCAAGCUGUGCAGCU | 10635 |
| 10859_16_89 | LILRB1 | EXON | - | chr19: 54636772-54636792 | UGAGGGUCAAGCUGUGCAGC | 10636 |
| 10859_16_92 | LILRB1 | EXON | - | chr19: 54636789-54636809 | CUCAGUUGCCUCCCGUCUGA | 10637 |
| 10859_16_93 | LILRB1 | EXON | - | chr19: 54636790-54636810 | GCUCAGUUGCCUCCCGUCUG | 10638 |
| 10859_16_97 | LILRB1 | EXON | - | chr19: 54636812-54636832 | GGCCCUUCCUGGGAUGGAGG | 10639 |
| 10859_16_98 | LILRB1 | EXON | - | chr19: 54636815-54636835 | GAGGGCCCUUCCUGGGAUGG | 10640 |
| 10859_16_101 | LILRB1 | EXON | - | chr19: 54636818-54636838 | GGAGAGGGCCCUUCCUGGGA | 10641 |
| 10859_16_104 | LILRB1 | EXON | - | chr19: 54636822-54636842 | AGCUGGAGAGGGCCCUUCCU | 10642 |
| 10859_16_105 | LILRB1 | EXON | - | chr19: 54636823-54636843 | CAGCUGGAGAGGGCCCUUCC | 10643 |
| 10859_16_108 | LILRB1 | EXON | - | chr19: 54636833-54636853 | AUGCUGGGCACAGCUGGAGA | 10644 |
| 10859_16_109 | LILRB1 | EXON | - | chr19: 54636834-54636854 | GAUGCUGGGCACAGCUGGAG | 10645 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_16_112 | LILRB1 | EXON | - | chr19: 54636839-54636859 | GCGUAGAUGCUGGGCACAGC | 10646 |
| 10859_16_115 | LILRB1 | EXON | - | chr19: 54636848-54636868 | GCCAGAGUGGCGUAGAUGCU | 10647 |
| 10859_16_116 | LILRB1 | EXON | - | chr19: 54636849-54636869 | GGCCAGAGUGGCGUAGAUGC | 10648 |
| 10859_16_118 | LILRB1 | EXON | - | chr19: 54636861-54636881 | GGGCUAGUGGAUGGCCAGAG | 10649 |
| 10859_16_120 | LILRB1 | EXON | - | chr19: 54636870-54636890 | UCCCCCCUGGGCUAGUGGA | 10650 |
| 10859_16_121 | LILRB1 | EXON | - | chr19: 54636874-54636894 | UGCGUCCCCCCUGGGCUAG | 10651 |
| 10859_16_123 | LILRB1 | EXON | - | chr19: 54636881-54636901 | UGGGGUCUGCGUCCCCCCU | 10652 |
| 10859_16_124 | LILRB1 | EXON | - | chr19: 54636882-54636902 | GUGGGGUCUGCGUCCCCCCC | 10653 |
| 10859_16_127 | LILRB1 | EXON | - | chr19: 54636899-54636919 | UCCAGACUCCAUGGAGUGUG | 10654 |
| 10859_16_128 | LILRB1 | EXON | - | chr19: 54636900-54636920 | UUCCAGACUCCAUGGAGUGU | 10655 |
| 10859_16_129 | LILRB1 | EXON | - | chr19: 54636901-54636921 | AUUCCAGACUCCAUGGAGUG | 10656 |
| 10859_16_132 | LILRB1 | EXON | - | chr19: 54636908-54636928 | CCCAUGCAUUCCAGACUCCA | 10657 |
| 10859_16_135 | LILRB1 | EXON | - | chr19: 54636936-54636956 | UCCAAUGGUGUCCACUGGGG | 10658 |
| 10859_16_136 | LILRB1 | EXON | - | chr19: 54636937-54636957 | GUCCAAUGGUGUCCACUGGG | 10659 |
| 10859_16_137 | LILRB1 | EXON | - | chr19: 54636938-54636958 | GGUCCAAUGGUGUCCACUGG | 10660 |
| 10859_16_139 | LILRB1 | EXON | - | chr19: 54636939-54636959 | GGGUCCAAUGGUGUCCACUG | 10661 |
| 10859_16_141 | LILRB1 | EXON | - | chr19: 54636940-54636960 | GGGGUCCAAUGGUGUCCACU | 10662 |
| 10859_16_143 | LILRB1 | EXON | - | chr19: 54636941-54636961 | UGGGGUCCAAUGGUGUCCAC | 10663 |
| 10859_16_146 | LILRB1 | EXON | - | chr19: 54636951-54636971 | CCAGGCUGGGUGGGGUCCAA | 10664 |
| 10859_16_147 | LILRB1 | EXON | - | chr19: 54636959-54636979 | GGGUAGAUCCAGGCUGGGUG | 10665 |
| 10859_16_148 | LILRB1 | EXON | - | chr19: 54636960-54636980 | GGGGUAGAUCCAGGCUGGGU | 10666 |
| 10859_16_150 | LILRB1 | EXON | - | chr19: 54636961-54636981 | UGGGGUAGAUCCAGGCUGGG | 10667 |
| 10859_16_152 | LILRB1 | EXON | - | chr19: 54636964-54636984 | UCCUGGGGUAGAUCCAGGCU | 10668 |
| 10859_16_153 | LILRB1 | EXON | - | chr19: 54636965-54636985 | CUCCUGGGGUAGAUCCAGGC | 10669 |
| 10859_16_156 | LILRB1 | EXON | - | chr19: 54636969-54636989 | GAGUCCUCCUGGGGUAGAUCC | 10670 |

TABLE 6d-continued

Targeting Domains for human LILRB1, an exemplary target of an NK inhibitory molecule.

| Id | Target | Region | Strand | Chromosomal location | gRNA targeting domain sequence | SEQ ID NO: |
|---|---|---|---|---|---|---|
| 10859_16_157 | LILRB1 | EXON | - | chr19: 54636979-54636999 | AAAGUUCCCAGAGUCUCCUG | 10671 |
| 10859_16_158 | LILRB1 | EXON | - | chr19: 54636980-54637000 | AAAAGUUCCCAGAGUCUCCU | 10672 |
| 10859_16_159 | LILRB1 | EXON | - | chr19: 54636981-54637001 | UAAAAGUUCCCAGAGUCUCC | 10673 |

TABLE 6e

Exemplary preferred targeting domains for gRNA molecules targeting CD3E

| Targeting Domain ID | Strand | Target Sequence Location (hg38) | Targeting domain sequence | SEQ ID NO: |
|---|---|---|---|---|
| CR002230 | + | Chr11: 118304702-118304724 | AGGCCUCUCUACUUCCUGUG | 10677 |
| CR002231 | + | Chr11: 118304703-118304725 | GGCCUCUCUACUUCCUGUGU | 10678 |
| CR002232 | + | Chr11: 118304704-118304726 | GCCUCUCUACUUCCUGUGUG | 10679 |
| CR002233 | - | Chr11: 118304570-118304592 | GACUCUGACAAUACCUGGAG | 10680 |
| CR002234 | - | Chr11: 118304571-118304593 | GGACUCUGACAAUACCUGGA | 10681 |
| CR002235 | - | Chr11: 118304575-118304597 | AAGAGGACUCUGACAAUACC | 10682 |
| CR002236 | - | Chr11: 118304592-118304614 | UUCCUAGAAGGCCAAACAAG | 10683 |
| CR002237 | - | Chr11: 118304604-118304626 | GGUCCCACAGCCUUCCUAGA | 10684 |
| CR002238 | - | Chr11: 118304625-118304647 | UGGACUGGUUGAAGAAAGCU | 10685 |
| CR002239 | - | Chr11: 118304640-118304662 | GCAGAGGCCUCCACCUGGAC | 10686 |
| CR002240 | - | Chr11: 118304656-118304678 | CUUGGAAACGUUCAAGGCAG | 10687 |
| CR002241 | - | Chr11: 118304662-118304684 | ACCUCACUUGGAAACGUUCA | 10688 |
| CR002242 | - | Chr11: 118304674-118304696 | CCUGCGGGUUUUACCUCACU | 10689 |
| CR002243 | - | Chr11: 118304689-118304711 | AGAGAGGCCUCUGGGCCUGC | 10690 |
| CR002244 | - | Chr11: 118304697-118304719 | CAGGAAGUAGAGAGGCCUCU | 10691 |
| CR002245 | - | Chr11: 118304705-118304727 | ACCCCACACAGGAAGUAGAG | 10692 |
| CR002246 | - | Chr11: 118304716-118304738 | AGGGUUUCUGAACCCCACAC | 10693 |
| CR002247 | - | Chr11: 118304736-118304758 | CCUGAGGCUGGGAGGGGAGG | 10694 |
| CR002248 | - | Chr11: 118304747-118304769 | UGAAGCAGGCACCUGAGGCU | 10695 |
| CR002249 | - | Chr11: 118304748-118304770 | CUGAAGCAGGCACCUGAGGC | 10696 |
| CR002250 | - | Chr11: 118304752-118304774 | UUUUCUGAAGCAGGCACCUG | 10697 |
| CR002251 | + | Chr11: 118304889-118304911 | UCCAGAAGUAGUAAGUCUGC | 10698 |
| CR002252 | + | Chr11: 118304940-118304962 | CCAUGAAACAAAGAUGCAGU | 10699 |
| CR002253 | + | Chr11: 118304941-118304963 | CAUGAAACAAAGAUGCAGUC | 10700 |
| CR002254 | + | Chr11: 118304951-118304973 | AGAUGCAGUCGGGCACUCAC | 10701 |

TABLE 6e-continued

Exemplary preferred targeting domains for gRNA molecules targeting CD3E

| Targeting Domain ID | Strand | Target Sequence Location (hg38) | Targeting domain sequence | SEQ ID NO: |
|---|---|---|---|---|
| CR002255 | + | Chr11: 118304961-118304983 | GGGCACUCACUGGAGAGUUC | 10702 |
| CR002256 | + | Chr11: 118304962-118304984 | GGCACUCACUGGAGAGUUCU | 10703 |
| CR002257 | − | Chr11: 118304912-118304934 | UUACUUUACUAAGAUGGCGG | 10704 |
| CR002258 | − | Chr11: 118304915-118304937 | CUGUUACUUUACUAAGAUGG | 10705 |
| CR002259 | − | Chr11: 118304918-118304940 | GGACUGUUACUUUACUAAGA | 10706 |
| CR002260 | − | Chr11: 118304939-118304961 | CGACUGCAUCUUUGUUUCAU | 10707 |
| CR002261 | − | Chr11: 118304940-118304962 | CCGACUGCAUCUUUGUUUCA | 10708 |
| CR002262 | − | Chr11: 118304985-118305007 | ACUCACCUGAUAAGAGGCAG | 10709 |
| CR002263 | − | Chr11: 118304991-118305013 | CAUCCUACUCACCUGAUAAG | 10710 |
| CR002264 | + | Chr11: 118307269-118307291 | UUUCUUAUUUAUUUCUAGU | 10711 |
| CR002265 | + | Chr11: 118307276-118307298 | UUUAUUUUCUAGUUGGCGUU | 10712 |
| CR002266 | + | Chr11: 118307277-118307299 | UUAUUUUCUAGUUGGCGUUU | 10713 |
| CR002267 | + | Chr11: 118307278-118307300 | UAUUUUCUAGUUGGCGUUUG | 10714 |
| CR002268 | + | Chr11: 118307279-118307301 | AUUUUCUAGUUGGCGUUUGG | 10715 |
| CR002269 | + | Chr11: 118308419-118308441 | CUUUUCAGGUAAUGAAGAAA | 10716 |
| CR002270 | + | Chr11: 118312617-118312639 | GCAUAUAAAGUCUCCAUCUC | 10717 |
| CR002271 | + | Chr11: 118312653-118312675 | UUGACAUGCCCUCAGUAUCC | 10718 |
| CR002272 | + | Chr11: 118312669-118312691 | AUCCUGGAUCUGAAAUACUA | 10719 |
| CR002273 | + | Chr11: 118312695-118312717 | CACAAUGAUAAAAACAUAGG | 10720 |
| CR002274 | + | Chr11: 118312703-118312725 | UAAAAACAUAGGCGGUGAUG | 10721 |
| CR002275 | + | Chr11: 118312719-118312741 | GAUGAGGAUGAUAAAAACAU | 10722 |
| CR002276 | + | Chr11: 118312730-118312752 | UAAAAACAUAGGCAGUGAUG | 10723 |
| CR002277 | + | Chr11: 118312748-118312770 | UGAGGAUCACCUGUCACUGA | 10724 |
| CR002278 | + | Chr11: 118312763-118312785 | ACUGAAGGAAUUUCAGAAU | 10725 |
| CR002279 | + | Chr11: 118312773-118312795 | UUUUCAGAAUUGGAGCAAAG | 10726 |
| CR002280 | + | Chr11: 118312838-118312860 | GAACUUUUAUCUCUACCUGA | 10727 |
| CR002281 | − | Chr11: 118312630-118312652 | UAUUACUGUGGUUCCAGAGA | 10728 |
| CR002282 | − | Chr11: 118312642-118312664 | AGGGCAUGUCAAUAUUACUG | 10729 |
| CR002283 | − | Chr11: 118312661-118312683 | UUUCAGAUCCAGGAUACUGA | 10730 |
| CR002284 | − | Chr11: 118312662-118312684 | AUUUCAGAUCCAGGAUACUG | 10731 |
| CR002285 | − | Chr11: 118312671-118312693 | UGCCAUAGUAUUUCAGAUCC | 10732 |
| CR002286 | − | Chr11: 118312757-118312779 | CUGAAAAUUCCUUCAGUGAC | 10733 |
| CR002287 | − | Chr11: 118312811-118312833 | CUUCUGGUUUGCUUCCUCUG | 10734 |
| CR002288 | − | Chr11: 118312812-118312834 | UCUUCUGGUUUGCUUCCUCU | 10735 |
| CR002289 | − | Chr11: 118312813-118312835 | AUCUUCUGGUUUGCUUCCUC | 10736 |
| CR002290 | − | Chr11: 118312827-118312849 | AGAUAAAAGUUCGCAUCUUC | 10737 |

TABLE 6e-continued

Exemplary preferred targeting domains for gRNA molecules targeting CD3E

| Targeting Domain ID | Strand | Target Sequence Location (hg38) | Targeting domain sequence | SEQ ID NO: |
|---|---|---|---|---|
| CR002291 | − | Chr11: 118312853-118312875 | CUGGAUUACCUCUUGCCCUC | 10738 |
| CR002292 | + | Chr11: 118313720-118313742 | CAUGGAGAUGGAUGUGAUGU | 10739 |
| CR002293 | + | Chr11: 118313758-118313780 | UAGUGGACAUCUGCAUCACU | 10740 |
| CR002294 | + | Chr11: 118313760-118313782 | GUGGACAUCUGCAUCACUGG | 10741 |
| CR002295 | + | Chr11: 118313774-118313796 | CACUGGGGCUUGCUGCUGC | 10742 |
| CR002296 | + | Chr11: 118313801-118313823 | CUACUGGAGCAAGAAUAGAA | 10743 |
| CR002297 | + | Chr11: 118313807-118313829 | GAGCAAGAAUAGAAAGGCCA | 10744 |
| CR002298 | + | Chr11: 118313826-118313848 | AAGGCCAAGCCUGUGACACG | 10745 |
| CR002299 | + | Chr11: 118313831-118313853 | CAAGCCUGUGACACGAGGAG | 10746 |
| CR002300 | − | Chr11: 118313746-118313768 | GAUGUCCACUAUGACAAUUG | 10747 |
| CR002301 | − | Chr11: 118313824-118313846 | UCGUGUCACAGGCUUGGCCU | 10748 |
| CR002302 | − | Chr11: 118313830-118313852 | CGCUCCUCGUGUCACAGGCU | 10749 |
| CR002303 | − | Chr11: 118313835-118313857 | GCACCCGCUCCUCGUGUCAC | 10750 |
| CR002304 | + | Chr11: 118314442-118314464 | CCGCAGGACAAAACAAGGAG | 10751 |
| CR002305 | − | Chr11: 118314465-118314487 | UCUGGGUUGGGAACAGGUGG | 10752 |
| CR002306 | − | Chr11: 118314468-118314490 | UAGUCUGGGUUGGGAACAGG | 10753 |
| CR002307 | − | Chr11: 118314471-118314493 | UCAUAGUCUGGGUUGGGAAC | 10754 |
| CR002308 | − | Chr11: 118314477-118314499 | GUUACCUCAUAGUCUGGGUU | 10755 |
| CR002309 | − | Chr11: 118314478-118314500 | CGUUACCUCAUAGUCUGGGU | 10756 |
| CR002310 | − | Chr11: 118314482-118314504 | CCCACGUUACCUCAUAGUCU | 10757 |
| CR002311 | − | Chr11: 118314483-118314505 | UCCCACGUUACCUCAUAGUC | 10758 |
| CR002312 | + | Chr11: 118315472-118315494 | UAUUUCACCCCCAGCCCAUC | 10759 |
| CR002313 | + | Chr11: 118315477-118315499 | CACCCCCAGCCCAUCCGGAA | 10760 |
| CR002314 | + | Chr11: 118315484-118315506 | AGCCCAUCCGGAAAGGCCAG | 10761 |
| CR002315 | + | Chr11: 118315485-118315507 | GCCCAUCCGGAAAGGCCAGC | 10762 |
| CR002316 | + | Chr11: 118315498-118315520 | GGCCAGCGGGACCUGUAUUC | 10763 |
| CR002317 | + | Chr11: 118315528-118315550 | CAGAGACGCAUCUGACCCUC | 10764 |

TABLE 6f

Exemplary preferred targeting domains for gRNA molecules targeting CD3G

| Targeting Domain Id | Exon | Strand | Target Sequence Location (hg38) | Targeting Domain Sequence | SEQ ID NO: |
|---|---|---|---|---|---|
| CR005349 | 3 | − | chr11: 118349904-118349926 | UUACACUGAUACAUCCCUCG | 10765 |
| CR005350 | 4 | − | chr11: 118350673-118350695 | GCAUUCUUUUACCUCUCGAC | 10766 |
| CR005351 | 3 | − | chr11: 118349903-118349925 | UACACUGAUACAUCCCUCGA | 10767 |
| CR005352 | 3 | − | chr11: 118349896-118349918 | AUACAUCCCUCGAGGGUCCU | 10768 |
| CR005353 | 5 | − | chr11: 118351652-118351674 | UACCUGGUAGAGCUGGUCAU | 10769 |

TABLE 6f-continued

Exemplary preferred targeting domains for gRNA molecules targeting CD3G

| Targeting Domain Id | Exon | Strand | Target Sequence Location (hg38) | Targeting Domain Sequence | SEQ ID NO: |
|---|---|---|---|---|---|
| CR005354 | 3 | + | chr11: 118349907-118349929 | CGAGGGAUGUA-UCAGUGUAA | 10770 |
| CR005355 | 4 | + | chr11: 118350640-118350662 | GGUCUACUUCA-UUGCUGGAC | 10771 |
| CR005356 | 3 | + | chr11: 118349890-118349912 | GUAAUGCCAAG-GACCCUCGA | 10772 |
| CR005357 | 5 | − | chr11: 118351651-118351673 | ACCUGGUAGAG-CUGGUCAUU | 10773 |
| CR005358 | 4 | + | chr11: 118350618-118350640 | GCAUUUCGUC-CUUGCUGUU | 10774 |
| CR005359 | 4 | + | chr11: 118350635-118350657 | GUUGGGGUCUA-CUUCAUUGC | 10775 |
| CR005360 | 6 | − | chr11: 118352405-118352427 | GUCAUCUUCUC-GAUCCUUGA | 10776 |
| CR005361 | 6 | − | chr11: 118352404-118352426 | UCAUCUUCUCG-AUCCUUGAG | 10777 |
| CR005362 | 3 | + | chr11: 118349760-118349782 | GUGUAUGACUA-UCAAGAAGA | 10778 |
| CR005363 | 3 | + | chr11: 118349738-118349760 | UUCAGGAAACC-ACUUGGUUA | 10779 |

TABLE 6g

Exemplary preferred targeting domains for gRNA molecules targeting CD3D

| Targeting Domain ID | Exon | Strand | Target Sequence Location (hg38) | Targeting Domain Sequence | SEQ ID NO: |
|---|---|---|---|---|---|
| CR005334 | 2 | + | chr11: 118340373-118340395 | ACUUCGAUAAU-GAACUUGCA | 10780 |
| CR005335 | 5 | + | chr11: 118339204-118339226 | AGCAUCAUCUC-GAUCUCGGA | 10781 |
| CR005336 | 5 | + | chr11: 118339203-118339225 | GAGCAUCAUCU-CGAUCUCGG | 10782 |
| CR005337 | 2 | − | chr11: 118340453-118340475 | GGACCUGGGAA-AACGCAUCC | 10783 |
| CR005338 | 2 | − | chr11: 118340467-118340489 | GACAUUACAAG-ACUGGACCU | 10784 |
| CR005339 | 2 | − | chr11: 118340443-118340465 | AAACGCAUCCU-GGACCCACG | 10785 |
| CR005340 | 5 | + | chr11: 118339004-118339026 | GGCGAGAUCCC-AAGCAAGUC | 10786 |
| CR005341 | 5 | + | chr11: 118339200-118339222 | ACUGAGCAUCA-UCUCGAUCU | 10787 |
| CR005342 | 5 | + | chr11: 118339205-118339227 | GCAUCAUCUCG-AUCUCGGAG | 10788 |
| CR005343 | 4 | − | chr11: 118339469-118339491 | CCGACACACAA-GCUCUGUUG | 10789 |
| CR005344 | 2 | + | chr11: 118340429-118340451 | UACACCUAUAU-AUUCCUCGU | 10790 |
| CR005345 | 2 | − | chr11: 118340558-118340580 | GAUACCUAUAG-AGGAACUUG | 10791 |
| CR005346 | 5 | + | chr11: 118339027-118339049 | ACAACUCCCAC-GCCUUGCCC | 10792 |
| CR005347 | 2 | + | chr11: 118340428-118340450 | UUACACCUAUA-UAUUCCUCG | 10793 |
| CR005348 | 5 | − | chr11: 118339150-118339172 | GGAACAAGUGA-ACCUGAGAC | 10794 |

In aspects of the invention, a gRNA to TRAC which includes the targeting domain of CR00961 (SEQ ID NO: 5569, underlined below, or modified version thereof (also as underlined below)), e.g., one of the gRNA molecules described below, is used in the CRISPR systems, methods, cells and other aspects and embodiments of the invention (and combinations thereof), including in aspects involving more than one gRNA molecule, e.g., described herein:

sgRNA CR00961 #1:
(SEQ ID NO: 7833)
AGAGUCUCUCAGCUGGUACAGUUUUAGAGCUAGAAAUAGCAAGUUAAAAU

AAGGCUAGUCCGUUAUCAACUUGAAAAAGUGGCACCGAGUCGGUGCUUUU sgRNA CR00961 #2:
(SEQ ID NO: 7834)
mA*mG*mA*GUCUCUCAGCUGGUACAGUUUUAGAGCUAGAAAUAGCAAGU

UAAAAUAAGGCUAGUCCGUUAUCAACUUGAAAAAGUGGCACCGAGUCGGU

GCU*mU*mU*mU sgRNA CR00961 #3:
(SEQ ID NO: 7835)
mA*mG*mA*GUCUCUCAGCUGGUACAGUUUUAGAGCUAGAAAUAGCAAGU

UAAAAUAAGGCUAGUCCGUUAUCAACUUGAAAAAGUGGCACCGAGUCGGU

GCmU*mU*mU*U dgRNA CR00961 #1:
crRNA:
(SEQ ID NO: 7836)
AGAGUCUCUCAGCUGGUACAGUUUUAGAGCUAUGCUGUUUUG tracr:
(SEQ ID NO: 6660)
AACAGCAUAGCAAGUUAAAAUAAGGCUAGUCCGUUAUCAACUUGAAAAAG

UGGCACCGAGUCGGUGCUUUUUUU dgRNA CR00961 #2:
crRNA:
(SEQ ID NO: 7837)
mA*mG*mA*GUCUCUCAGCUGGUACAGUUUUAGAGCUAUGCUGUU*mU* mU*mG tracr:
(SEQ ID NO: 10798)
mA*mA*mC*AGCAUAGCAAGUUAAAAUAAGGCUAGUCCGUUAUCAACUUG AAAAAGUGGCACCGAGUCGGUGCUUUU*mU*mU*mU dgRNA CR00961 #3:
crRNA:
(SEQ ID NO: 7837)
mA*mG*mA*GUCUCUCAGCUGGUACAGUUUUAGAGCUAUGCUGUU*mU* mU*mG tracr:
(SEQ ID NO: 6660)
AACAGCAUAGCAAGUUAAAAUAAGGCUAGUCCGUUAUCAACUUGAAAAAG

UGGCACCGAGUCGGUGCUUUUUUU.

In aspects of the invention, a gRNA to TRAC which includes the targeting domain of CR00984 (SEQ ID NO: 5592, underlined below, or modified version thereof (also as underlined below)), e.g., one of the gRNA molecules described below, is used in the CRISPR systems, methods, cells and other aspects and embodiments of the invention (and combinations thereof), including in aspects involving more than one gRNA molecule, e.g., described herein:

sgRNA CR00984 #1:
(SEQ ID NO: 7838)
UUCGGAACCCAAUCACUGACGUUUUAGAGCUAGAAAUAGCAAGUUAAAAU

AAGGCUAGUCCGUUAUCAACUUGAAAAAGUGGCACCGAGUCGGUGCUUUU sgRNA CR00984 #2:
(SEQ ID NO: 7839)
mU*mU*mC*GGAACCCAAUCACUGACGUUUUAGAGCUAGAAAUAGCAAGU

UAAAAUAAGGCUAGUCCGUUAUCAACUUGAAAAAGUGGCACCGAGUCGGU

GCU*mU*mU*mU sgRNA CR00984 #3:
(SEQ ID NO: 7840)
mU*mU*mC*GGAACCCAAUCACUGACGUUUUAGAGCUAGAAAUAGCAAGU

UAAAAUAAGGCUAGUCCGUUAUCAACUUGAAAAAGUGGCACCGAGUCGGU

GCmU*mU*mU*U dgRNA CR00984 #1:
crRNA:
(SEQ ID NO: 7841)
UUCGGAACCCAAUCACUGACGUUUUAGAGCUAUGCUGUUUUG tracr:
(SEQ ID NO: 6660)
AACAGCAUAGCAAGUUAAAAUAAGGCUAGUCCGUUAUCAACUUGAAAAAG

UGGCACCGAGUCGGUGCUUUUUUU dgRNA CR00984 #2:
crRNA:
(SEQ ID NO: 7842)
mU*mU*mC*GGAACCCAAUCACUGACGUUUUAGAGCUAUGCUGUU*mU* mU*mG tracr:
(SEQ ID NO: 10798)
mA*mA*mC*AGCAUAGCAAGUUAAAAUAAGGCUAGUCCGUUAUCAACUUG AAAAAGUGGCACCGAGUCGGUGCUUUU*mU*mU*mU dgRNA CR00984 #3:
crRNA:
(SEQ ID NO: 7842)
mU*mU*mC*GGAACCCAAUCACUGACGUUUUAGAGCUAUGCUGUU*mU* mU*mG tracr:
(SEQ ID NO: 6660)
AACAGCAUAGCAAGUUAAAAUAAGGCUAGUCCGUUAUCAACUUGAAAAAG

UGGCACCGAGUCGGUGCUUUUUUU.

In aspects of the invention, a gRNA to TRBC which includes the targeting domain of CR00798 (SEQ ID NO: 5694, underlined below, or modified version thereof (also as underlined below)), e.g., one of the gRNA molecules described below, is used in the CRISPR systems, methods, cells and other aspects and embodiments of the invention (and combinations thereof), including in aspects involving more than one gRNA molecule, e.g., described herein:

sgRNA CR00798 #1:
(SEQ ID NO: 7843)
UGGCUCAAACACAGCGACCUGUUUUAGAGCUAGAAAUAGCAAGUUAAAAU

AAGGCUAGUCCGUUAUCAACUUGAAAAAGUGGCACCGAGUCGGUGCUUUU sgRNA CR00798 #2:
(SEQ ID NO: 7844)
mU*mG*mG*CUCAAACACAGCGACCUGUUUUAGAGCUAGAAAUAGCAAGU

UAAAAUAAGGCUAGUCCGUUAUCAACUUGAAAAAGUGGCACCGAGUCGGU

GCU*mU*mU*mU sgRNA CR00798 #3:
(SEQ ID NO: 7845)
mU*mG*mG*CUCAAACACAGCGACCUGUUUUAGAGCUAGAAAUAGCAAGU

UAAAAUAAGGCUAGUCCGUUAUCAACUUGAAAAAGUGGCACCGAGUCGGU

GCmU*mU*mU*U dgRNA CR00798 #1:
crRNA:
(SEQ ID NO: 7846)
UGGCUCAAACACAGCGACCUGUUUUAGAGCUAUGCUGUUUUG tracr:
(SEQ ID NO: 6660)
AACAGCAUAGCAAGUUAAAAUAAGGCUAGUCCGUUAUCAACUUGAAAAAG

UGGCACCGAGUCGGUGCUUUUUUU dgRNA CR00798 #2:
crRNA:
(SEQ ID NO: 7847)
mU*mG*mG*CUCAAACACAGCGACCUGUUUUAGAGCUAUGCUGUU*mU* mU*mG tracr:
(SEQ ID NO: 10798)
mA*mA*mC*AGCAUAGCAAGUUAAAAUAAGGCUAGUCCGUUAUCAACUUG AAAAAGUGGCACCGAGUCGGUGCUUUU*mU*mU*mU dgRNA CR00798 #3:
crRNA:
(SEQ ID NO: 7847)
mU*mG*mG*CUCAAACACAGCGACCUGUUUUAGAGCUAUGCUGUU*mU* mU*mG tracr:
(SEQ ID NO: 6660)
AACAGCAUAGCAAGUUAAAAUAAGGCUAGUCCGUUAUCAACUUGAAAAAG

UGGCACCGAGUCGGUGCUUUUUUU.

In aspects of the invention, a gRNA to TRBC which includes the targeting domain of CR00823 (SEQ ID NO: 5719, underlined below, or modified version thereof (also as underlined below)), e.g., one of the gRNA molecules described below, is used in the CRISPR systems, methods, cells and other aspects and embodiments of the invention (and combinations thereof), including in aspects involving more than one gRNA molecule, e.g., described herein:

sgRNA CR00823 #1:
(SEQ ID NO: 7848)
UCCCUAGCAAGAUCUCAUAGGUUUUAGAGCUAGAAAUAGCAAGUUAAAAU

AAGGCUAGUCCGUUAUCAACUUGAAAAAGUGGCACCGAGUCGGUGCUUUU sgRNA CR00823 #2:
(SEQ ID NO: 7849)
mU*mC*mC*CUAGCAAGAUCUCAUAGGUUUUAGAGCUAGAAAUAGCAAGU

UAAAAUAAGGCUAGUCCGUUAUCAACUUGAAAAAGUGGCACCGAGUCGGU

GCU*mU*mU*mU sgRNA CR00823 #3:
(SEQ ID NO: 7850)
mU*mC*mC*CUAGCAAGAUCUCAUAGGUUUUAGAGCUAGAAAUAGCAAGU

UAAAAUAAGGCUAGUCCGUUAUCAACUUGAAAAAGUGGCACCGAGUCGGU

GCmU*mU*mU*U dgRNA CR00823 #1:
crRNA:
(SEQ ID NO: 7851)
UCCCUAGCAAGAUCUCAUAGGUUUUAGAGCUAUGCUGUUUG tracr:
(SEQ ID NO: 6660)
AACAGCAUAGCAAGUUAAAAUAAGGCUAGUCCGUUAUCAACUUGAAAAAG

UGGCACCGAGUCGGUGCUUUUUUU dgRNA CR00823 #2:
crRNA:
(SEQ ID NO: 7852)
mU*mC*mC*CUAGCAAGAUCUCAUAGGUUUUAGAGCUAUGCUGUU*mU* mU*mG tracr:
(SEQ ID NO: 10798)
mA*mA*mC*AGCAUAGCAAGUUAAAAUAAGGCUAGUCCGUUAUCAACUUG AAAAAGUGGCACCGAGUCGGUGCUUUU*mU*mU*mU dgRNA CR00823 #3:
crRNA:
(SEQ ID NO: 7852)
mU*mC*mC*CUAGCAAGAUCUCAUAGGUUUUAGAGCUAUGCUGUU*mU* mU*mG tracr:
(SEQ ID NO: 6660)
AACAGCAUAGCAAGUUAAAAUAAGGCUAGUCCGUUAUCAACUUGAAAAAG

UGGCACCGAGUCGGUGCUUUUUUU.

In aspects of the invention, a gRNA to B2M which includes the targeting domain of CR00442 (SEQ ID NO: 5496, underlined below, or modified version thereof (also as underlined below)), e.g., one of the gRNA molecules described below, is used in the CRISPR systems, methods, cells and other aspects and embodiments of the invention (and combinations thereof), including in aspects involving more than one gRNA molecule, e.g., described herein:

sgRNA CR00442 #1:
(SEQ ID NO: 7853)
GGCCACGGAGCGAGACAUCUGUUUUAGAGCUAGAAAUAGCAAGUUAAAAU

AAGGCUAGUCCGUUAUCAACUUGAAAAAGUGGCACCGAGUCGGUGCUUUU sgRNA CR00442 #2:
(SEQ ID NO: 7854)
mG*mG*mC*CACGGAGCGAGACAUCUGUUUUAGAGCUAGAAAUAGCAAGU

UAAAAUAAGGCUAGUCCGUUAUCAACUUGAAAAAGUGGCACCGAGUCGGU

GCU*mU*mU*mU sgRNA CR00442 #3:
(SEQ ID NO: 7855)
mG*mG*mC*CACGGAGCGAGACAUCUGUUUUAGAGCUAGAAAUAGCAAGU

UAAAAUAAGGCUAGUCCGUUAUCAACUUGAAAAAGUGGCACCGAGUCGGU

GCmU*mU*mU*U dgRNA CR00442 #1:
crRNA:
(SEQ ID NO: 7856)
GGCCACGGAGCGAGACAUCUGUUUUAGAGCUAUGCUGUUUG tracr:
(SEQ ID NO: 6660)
AACAGCAUAGCAAGUUAAAAUAAGGCUAGUCCGUUAUCAACUUGAAAAAG

UGGCACCGAGUCGGUGCUUUUUUU dgRNA CR00442 #2:
crRNA:
(SEQ ID NO: 7857)
mG*mG*mC*CACGGAGCGAGACAUCUGUUUUAGAGCUAUGCUGUU*mU* mU*mG

```
tracr:
                                      (SEQ ID NO: 10798)
mA*mA*mC*AGCAUAGCAAGUUAAAAUAAGGCUAGUCCGUUAUCAACUUG AAAAAGUGGCACCGAGUCGGUGCUUUU*mU*mU*mU dgRNA CR00442 #3:
crRNA:
                                      (SEQ ID NO: 7857)
mG*mG*mC*CACGGAGCGAGACAUCUGUUUUAGAGCUAUGCUGUU*mU* mU*mG tracr:
                                      (SEQ ID NO: 6660)
AACAGCAUAGCAAGUUAAAAUAAGGCUAGUCCGUUAUCAACUUGAAAAAG

UGGCACCGAGUCGGUGCUUUUUUU.
```

In aspects of the invention, a gRNA to B2M which includes the targeting domain of CR00444 (SEQ ID NO: 5498, underlined below, or modified version thereof (also as underlined below)), e.g., one of the gRNA molecules described below, is used in the CRISPR systems, methods, cells and other aspects and embodiments of the invention (and combinations thereof), including in aspects involving more than one gRNA molecule, e.g., described herein:

```
sgRNA CR00444 #1:
                                      (SEQ ID NO: 7858)
GAGUAGCGCGAGCACAGCUAGUUUUAGAGCUAGAAAUAGCAAGUUAAAAU

AAGGCUAGUCCGUUAUCAACUUGAAAAAGUGGCACCGAGUCGGUGCUUUU sgRNA CR00444 #2:
                                      (SEQ ID NO: 7859)
mG*mA*mU*AGCGCGAGCACAGCUAGUUUUAGAGCUAGAAAUAGCAAGUU

AAAAUAAGGCUAGUCCGUUAUCAACUUGAAAAAGUGGCACCGAGUCGGUG

CU*mU*mU*mU sgRNA CR00444 #3:
                                      (SEQ ID NO: 7860)
mG*mA*mU*AGCGCGAGCACAGCUAGUUUUAGAGCUAGAAAUAGCAAGUU

AAAAUAAGGCUAGUCCGUUAUCAACUUGAAAAAGUGGCACCGAGUCGGUG

CmU*mU*mU*U dgRNA CR00444 #1:
crRNA:
                                      (SEQ ID NO: 7861)
GAGUAGCGCGAGCACAGCUAGUUUUAGAGCUAUGCUGUUUUG tracr:
                                      (SEQ ID NO: 6660)
AACAGCAUAGCAAGUUAAAAUAAGGCUAGUCCGUUAUCAACUUGAAAAAG

UGGCACCGAGUCGGUGCUUUUUUU dgRNA CR00444 #2:
crRNA:
                                      (SEQ ID NO: 7862)
mG*mA*mU*AGCGCGAGCACAGCUAGUUUUAGAGCUAUGCUGUU*mU* mU*mG tracr:
                                      (SEQ ID NO: 10798)
mA*mA*mC*AGCAUAGCAAGUUAAAAUAAGGCUAGUCCGUUAUCAACUUG AAAAAGUGGCACCGAGUCGGUGCUUUU*mU*mU*mU dgRNA CR00444 #3:
crRNA:
                                      (SEQ ID NO: 7862)
mG*mA*mU*AGCGCGAGCACAGCUAGUUUUAGAGCUAUGCUGUU*mU* mU*mG tracr:
                                      (SEQ ID NO: 6660)
AACAGCAUAGCAAGUUAAAAUAAGGCUAGUCCGUUAUCAACUUGAAAAAG

UGGCACCGAGUCGGUGCUUUUUUU.
```

In aspects of the invention, a gRNA to FKBP1A which includes the targeting domain of CR002097 (SEQ ID NO: 6705, underlined below, or modified version thereof (also as underlined below)), e.g., one of the gRNA molecules described below, is used in the CRISPR systems, methods, cells and other aspects and embodiments of the invention (and combinations thereof), including in aspects involving more than one gRNA molecule, e.g., described herein:

```
sgRNA CR002097 #1:
                                      (SEQ ID NO: 7863)
CAAGCGCGGCCAGACCUGCGGUUUUAGAGCUAGAAAUAGCAAGUUAAAAU

AAGGCUAGUCCGUUAUCAACUUGAAAAAGUGGCACCGAGUCGGUGCUUUU sgRNA CR002097 #2:
                                      (SEQ ID NO: 7864)
mC*mA*mA*GCGCGGCCAGACCUGCGGUUUUAGAGCUAGAAAUAGCAAGU

UAAAAUAAGGCUAGUCCGUUAUCAACUUGAAAAAGUGGCACCGAGUCGGU

GCU*mU*mU*mU sgRNA CR002097 #3:
                                      (SEQ ID NO: 7865)
mC*mA*mA*GCGCGGCCAGACCUGCGGUUUUAGAGCUAGAAAUAGCAAGU

UAAAAUAAGGCUAGUCCGUUAUCAACUUGAAAAAGUGGCACCGAGUCGGU

GCmU*mU*mU*U dgRNA CR002097 #1:
crRNA:
                                      (SEQ ID NO: 7866)
CAAGCGCGGCCAGACCUGCGGUUUUAGAGCUAUGCUGUUUUG tracr:
                                      (SEQ ID NO: 6660)
AACAGCAUAGCAAGUUAAAAUAAGGCUAGUCCGUUAUCAACUUGAAAAAG

UGGCACCGAGUCGGUGCUUUUUUU dgRNA CR002097 #2:
crRNA:
                                      (SEQ ID NO: 7867)
mC*mA*mA*GCGCGGCCAGACCUGCGGUUUUAGAGCUAUGCUGUU*mU* mU*mG tracr:
                                      (SEQ ID NO: 10798)
mA*mA*mC*AGCAUAGCAAGUUAAAAUAAGGCUAGUCCGUUAUCAACUUG AAAAAGUGGCACCGAGUCGGUGCUUUU*mU*mU*mU dgRNA CR002097 #3:
crRNA:
                                      (SEQ ID NO: 7867)
mC*mA*mA*GCGCGGCCAGACCUGCGGUUUUAGAGCUAUGCUGUU*mU* mU*mG
```

-continued

```
tracr:
                                    (SEQ ID NO: 6660)
AACAGCAUAGCAAGUUAAAAUAAGGCUAGUCCGUUAUCAACUUGAAAAAG

UGGCACCGAGUCGGUGCUUUUUUU.
```

In aspects of the invention, a gRNA to FKBP1A which includes the targeting domain of CR002100 (SEQ ID NO: 6708, underlined below, or modified version thereof (also as underlined below)), e.g., one of the gRNA molecules described below, is used in the CRISPR systems, methods, cells and other aspects and embodiments of the invention (and combinations thereof), including in aspects involving more than one gRNA molecule, e.g., described herein:

```
sgRNA CR002100 #1:
                                    (SEQ ID NO: 7868)
CCGCUGGGCCCCCGACUCACGUUUUAGAGCUAGAAAUAGCAAGUUAAAAU

AAGGCUAGUCCGUUAUCAACUUGAAAAAGUGGCACCGAGUCGGUGCUUUU sgRNA CR002100 #2:
                                    (SEQ ID NO: 7869)
mC*mC*mG*CUGGGCCCCCGACUCACGUUUUAGAGCUAGAAAUAGCAAGU

UAAAAUAAGGCUAGUCCGUUAUCAACUUGAAAAAGUGGCACCGAGUCGGU

GCU*mU*mU*mU sgRNA CR002100 #3:
                                    (SEQ ID NO: 7870)
mC*mC*mG*CUGGGCCCCCGACUCACGUUUUAGAGCUAGAAAUAGCAAGU

UAAAAUAAGGCUAGUCCGUUAUCAACUUGAAAAAGUGGCACCGAGUCGGU

GCmU*mU*mU*U dgRNA CR002100 #1:
crRNA:
                                    (SEQ ID NO: 7871)
CCGCUGGGCCCCCGACUCACGUUUUAGAGCUAUGCUGUUUUG tracr:
                                    (SEQ ID NO: 6660)
AACAGCAUAGCAAGUUAAAAUAAGGCUAGUCCGUUAUCAACUUGAAAAAG

UGGCACCGAGUCGGUGCUUUUUUU dgRNA CR002100 #2:
crRNA:
                                    (SEQ ID NO: 7872)
mC*mC*mG*CUGGGCCCCCGACUCACGUUUUAGAGCUAUGCUGUU*mU* mU*mG tracr:
                                    (SEQ ID NO: 10798)
mA*mA*mC*AGCAUAGCAAGUUAAAAUAAGGCUAGUCCGUUAUCAACUUG AAAAAGUGGCACCGAGUCGGUGCUUUU*mU*mU*mU dgRNA CR002100 #3:
crRNA:
                                    (SEQ ID NO: 7872)
mC*mC*mG*CUGGGCCCCCGACUCACGUUUUAGAGCUAUGCUGUU*mU* mU*mG tracr:
                                    (SEQ ID NO: 6660)
AACAGCAUAGCAAGUUAAAAUAAGGCUAGUCCGUUAUCAACUUGAAAAAG

UGGCACCGAGUCGGUGCUUUUUUU.
```

In each of the gRNA molecules described above, a "*" denotes a phosphorothioate bond between the adjacent nucleotides, and "mN" (where N=A, G, C or U) denotes a 2'-OMe modified nucleotide. In embodiments, any of the gRNA molecules described herein, e.g., described above, is complexed with a Cas9 molecule, e.g., as described herein, to form a ribonuclear protein complex (RNP). Such RNPs are particularly useful in the methods, cells, and other aspects and embodiments of the invention, e.g., described herein.

III. Methods for Designing gRNAs

Methods for designing gRNAs are described herein, including methods for selecting, designing and validating target sequences. Exemplary targeting domains are also provided herein. Targeting Domains discussed herein can be incorporated into the gRNAs described herein.

Methods for selection and validation of target sequences as well as off-target analyses are described, e.g., in. Mali el al., 2013 SCIENCE 339(6121): 823-826; Hsu et al, 2013 NAT BIOTECHNOL, 31 (9): 827-32; Fu et al, 2014 NAT BIOTECHNOL, doi: 10.1038/nbt.2808. PubMed PM ID: 24463574; Heigwer et al, 2014 NAT METHODS 11(2): 122-3. doi: 10.1038/nmeth.2812. PubMed PMID: 24481216; Bae el al, 2014 BIOINFORMATICS PubMed PMID: 24463181; Xiao A el al, 2014 BIOINFORMATICS PubMed PMID: 24389662.

For example, a software tool can be used to optimize the choice of gRNA within a user's target sequence, e.g., to minimize total off-target activity across the genome. Off target activity may be other than cleavage. For each possible gRNA choice e.g., using S. pyogenes Cas9, the tool can identify all off-target sequences (e.g., preceding either NAG or NGG PAMs) across the genome that contain up to certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible gRNA is then ranked according to its total predicted off-target cleavage; the top-ranked gRNAs represent those that are likely to have the greatest on-target and the least off-target cleavage. Other functions, e.g., automated reagent design for CRISPR construction, primer design for the on-target Surveyor assay, and primer design for high-throughput detection and quantification of off-target cleavage via next-gen sequencing, can also be included in the tool. Candidate gRNA molecules can be evaluated by art-known methods or as described herein.

Although software algorithms may be used to generate an initial list of potential gRNA molecules, cutting efficiency and specificity will not necessarily reflect the predicted values, and gRNA molecules typically require screening in specific cell lines, e.g., primary human cell lines, e.g., primary human immune effector cells, e.g., primary human T cells, to determine, for example, cutting efficiency, indel formation, cutting specificity and change in desired phenotype. These properties may be assayed by the methods described herein.

IV. Cas Molecules

Cas9 Molecules

In preferred embodiments, the Cas molecule is a Cas9 molecule. Cas9 molecules of a variety of species can be used in the methods and compositions described herein. While the S. pyogenes Cas9 molecule are the subject of much of the disclosure herein, Cas9 molecules of, derived from, or based on the Cas9 proteins of other species listed herein can be used as well. In other words, other Cas9 molecules, e.g., S. thermophilus, Staphylococcus aureus and/or Neisseyor men-

*ingitidis* Cas9 molecules, may be used in the systems, methods and compositions described herein. Additional Cas9 species include: *Acidovorax avenae, Actinobacillus pleuropneumoniae, Actinobacillus succinogenes, Actinobacillus suis, Actinomyces* sp., cyclphilus denitrificans, *Aminomonas paucivorans, Bacillus cereus, Bacillus smithii, Bacillus thuringiensis, Bacteroides* sp., *Blastopirellula marina,* Bradyrhiz obium sp., *Brevibacillus laterosporus, Campylobacter coli, Campylobacter jejuni, Campylobacter lad,* Candidatus Puniceispirillum, *Clostridium cellulolyticum, Clostridium perfringens, Corynebacterium accolens, Corynebacterium diphtheria, Corynebacterium matruchotii, Dinoroseobacter sliibae, Eubacterium dolichum, Gamma* proteobacterium, *Gluconacetobacter diazotrophicus, Haemophilus parainfluenzae, Haemophilus sputorum, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis* sp., *Methylosinus trichosporium, Mobiluncus mulieris, Neisseria bacilliformis, Neisseria cinerea, Neisseria flavescens, Neisseria lactamica. Neisseria* sp., *Neisseria wadsworthii, Nitrosomonas* sp., *Parvibaculum lavamentivorans, Pasteurella multocida, Phascolarctobacterium succinatutens, Ralstonia syzygii, Rhodopseudomonas palustris, Rhodovulum* sp., *Simonsiella muelleri, Sphingomonas* sp., *Sporolactobacillus vineae, Staphylococcus lugdunensis, Streptococcus* sp., *Subdoligranulum* sp., *Tislrella mobilis, Treponema* sp., or *Verminephrobacter eiseniae.*

A Cas9 molecule, as that term is used herein, refers to a molecule that can interact with a gRNA molecule (e.g., sequence of a domain of a tracr) and, in concert with the gRNA molecule, localize (e.g., target or home) to a site which comprises a target sequence and PAM sequence.

In an embodiment, the Cas9 molecule is capable of cleaving a target nucleic acid molecule, which may be referred to herein as an active Cas9 molecule. In an embodiment, an active Cas9 molecule, comprises one or more of the following activities: a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double stranded break, which in an embodiment is the presence of two nickase activities; an endonuclease activity; an exonuclease activity; and a helicase activity, i.e., the ability to unwind the helical structure of a double stranded nucleic acid.

In an embodiment, an enzymatically active Cas9 molecule cleaves both DNA strands and results in a double stranded break. In an embodiment, a Cas9 molecule cleaves only one strand, e.g., the strand to which the gRNA hybridizes to, or the strand complementary to the strand the gRNA hybridizes with. In an embodiment, an active Cas9 molecule comprises cleavage activity associated with an HNH-like domain. In an embodiment, an active Cas9 molecule comprises cleavage activity associated with an N-terminal RuvC-like domain. In an embodiment, an active Cas9 molecule comprises cleavage activity associated with an HNH-like domain and cleavage activity associated with an N-terminal RuvC-like domain. In an embodiment, an active Cas9 molecule comprises an active, or cleavage competent, HNH-like domain and an inactive, or cleavage incompetent, N-terminal RuvC-like domain. In an embodiment, an active Cas9 molecule comprises an inactive, or cleavage incompetent, HNH-like domain and an active, or cleavage competent, N-terminal RuvC-like domain.

In an embodiment, the ability of an active Cas9 molecule to interact with and cleave a target nucleic acid is PAM sequence dependent. A PAM sequence is a sequence in the target nucleic acid. In an embodiment, cleavage of the target nucleic acid occurs upstream from the PAM sequence. Active Cas9 molecules from different bacterial species can recognize different sequence motifs (e.g., PAM sequences). In an embodiment, an active Cas9 molecule of *S. pyogenes* recognizes the sequence motif NGG and directs cleavage of a target nucleic acid sequence 1 to 10, e.g., 3 to 5, base pairs upstream from that sequence. See, e.g., Mali el al, SCIENCE 2013; 339(6121): 823-826. In an embodiment, an active Cas9 molecule of *S. thermophilus* recognizes the sequence motif NGGNG and NNAG AAW (W=A or T) and directs cleavage of a core target nucleic acid sequence 1 to 10, e.g., 3 to 5, base pairs upstream from these sequences. See, e.g., Horvath et al., SCIENCE 2010; 327(5962): 167-170, and Deveau et al, J BACTERIOL 2008; 190(4): 1390-1400. In an embodiment, an active Cas9 molecule of S. mulans recognizes the sequence motif NGG or NAAR (R-A or G) and directs cleavage of a core target nucleic acid sequence 1 to 10, e.g., 3 to 5 base pairs, upstream from this sequence. See, e.g., Deveau et al., J BACTERIOL 2008; 190(4): 1390-1400.

In an embodiment, an active Cas9 molecule of *S. aureus* recognizes the sequence motif NNGRR (R=A or G) and directs cleavage of a target nucleic acid sequence 1 to 10, e.g., 3 to 5, base pairs upstream from that sequence. See, e.g., Ran F. et al., NATURE, vol. 520, 2015, pp. 186-191. In an embodiment, an active Cas9 molecule of *N. meningitidis* recognizes the sequence motif NNNNGATT and directs cleavage of a target nucleic acid sequence 1 to 10, e.g., 3 to 5, base pairs upstream from that sequence. See, e.g., Hou et al., PNAS EARLY EDITION 2013, 1-6. The ability of a Cas9 molecule to recognize a PAM sequence can be determined, e.g., using a transformation assay described in Jinek et al, SCIENCE 2012, 337:816.

Some Cas9 molecules have the ability to interact with a gRNA molecule, and in conjunction with the gRNA molecule home (e.g., targeted or localized) to a core target domain, but are incapable of cleaving the target nucleic acid, or incapable of cleaving at efficient rates. Cas9 molecules having no, or no substantial, cleavage activity may be referred to herein as an inactive Cas9 (an enzymatically inactive Cas9), a dead Cas9, or a dCas9 molecule. For example, an inactive Cas9 molecule can lack cleavage activity or have substantially less, e.g., less than 20, 10, 5, 1 or 0.1% of the cleavage activity of a reference Cas9 molecule, as measured by an assay described herein.

Exemplary naturally occurring Cas9 molecules are described in Chylinski et al, RNA Biology 2013; 10:5, 727-737. Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 11 bacterial family, a cluster 12 bacterial family, a cluster 13 bacterial family, a cluster 14 bacterial family, a cluster 1 bacterial family, a cluster 16 bacterial family, a cluster 17 bacterial family, a cluster 18 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 51 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family.

Exemplary naturally occurring Cas9 molecules include a Cas9 molecule of a cluster 1 bacterial family. Examples include a Cas9 molecule of: S. pyogenes (e.g., strain SF370, MGAS 10270, MGAS 10750, MGAS2096, MGAS315, MGAS5005, MGAS6180, MGAS9429, NZ131 and SSI-1), S. thermophilus (e.g., strain LMD-9), S. pseudoporcinus (e.g., strain SPIN 20026), S. mutans (e.g., strain UA 159, NN2025), S. macacae (e.g., strain NCTC1 1558), S. gallolyticus (e.g., strain UCN34, ATCC BAA-2069), S. equines (e.g., strain ATCC 9812, MGCS 124), S. dysgalactiae (e.g., strain GGS 124), S. bovis (e.g., strain ATCC 700338), S. cmginosus (e.g.; strain F021 1), S. agalactiae* (e.g., strain NEM316, A909), Listeria monocytogenes (e.g., strain F6854), Listeria innocua (L. innocua, e.g., strain Clip 1 1262), Enterococcus italicus (e.g., strain DSM 15952), or Enterococcus faecium (e.g., strain 1,231,408). Additional exemplary Cas9 molecules are a Cas9 molecule of Neisseria meningitidis (Hou et' al. PNAS Early Edition 2013, 1-6) and a S. aureus Cas9 molecule.

In an embodiment, a Cas9 molecule, e.g., an active Cas9 molecule or inactive Cas9 molecule, comprises an amino acid sequence: having 60%, 65%, 70%, 75%, 80%, 85%, 90%, 95%, 96%, 97%, 98%, or 99% homology with; differs at no more than 1%, 2%, 5%, 10%, 15%, 20%, 30%, or 40% of the amino acid residues when compared with; differs by at least 1, 2, 5, 10 or 20 amino acids but by no more than 100, 80, 70, 60, 50, 40 or 30 amino acids from; or is identical to; any Cas9 molecule sequence described herein or a naturally occurring Cas9 molecule sequence, e.g., a Cas9 molecule from a species listed herein or described in Chylinski et al., RNA Biology 2013, 10:5, T2T-T,1 Hou et al. PNAS Early Edition 2013, 1-6.

In an embodiment, a Cas9 molecule comprises an amino acid sequence having 60%, 65%, 70%, 75%, 80%, 85%, 90%, 95%, 96%, 97%, 98%, or 99% homology with; differs at no more than 1%, 2%, 5%, 10%, 15%, 20%, 30%, or 40% of the amino acid residues when compared with; differs by at least 1, 2, 5, or 20 amino acids but by no more than 100, 80, 70, 60, 50, 40 or 30 amino acids from; or is identical to; S. pyogenes Cas9:

(SEQ ID NO: 6611)

Met Asp Lys Lys Tyr Ser Ile Gly Leu Asp Ile Gly
1               5                   10
Thr Asn Ser Val Gly Trp Ala Val Ile Thr Asp Glu
            15                  20
Tyr Lys Val Pro Ser Lys Lys Phe Lys Val Leu Gly
25                  30                      35
Asn Thr Asp Arg His Ser Ile Lys Lys Asn Leu Ile
            40                  45
Gly Ala Leu Leu Phe Asp Ser Gly Glu Thr Ala Glu
    50                  55                      60
Ala Thr Arg Leu Lys Arg Thr Ala Arg Arg Arg Tyr
            65                  70
Thr Arg Arg Lys Asn Arg Ile Cys Tyr Leu Gln Glu
        75                      80
Ile Phe Ser Asn Glu Met Ala Lys Val Asp Asp Ser
85                  90                      95
Phe Phe His Arg Leu Glu Glu Ser Phe Leu Val Glu
            100                 105
Glu Asp Lys Lys His Glu Arg His Pro Ile Phe Gly
    110                 115                     120
Asn Ile Val Asp Glu Val Ala Tyr His Glu Lys Tyr
                125                 130
Pro Thr Ile Tyr His Leu Arg Lys Lys Leu Val Asp
        135                 140
Ser Thr Asp Lys Ala Asp Leu Arg Leu Ile Tyr Leu
145                 150                     155
Ala Leu Ala His Met Ile Lys Phe Arg Gly His Phe
            160                 165
Leu Ile Glu Gly Asp Leu Asn Pro Asp Asn Ser Asp
    170                 175                     180
Val Asp Lys Leu Phe Ile Gln Leu Val Gln Thr Tyr
                185                 190
Asn Gln Leu Phe Glu Glu Asn Pro Ile Asn Ala Ser
        195                 200
Gly Val Asp Ala Lys Ala Ile Leu Ser Ala Arg Leu
205                 210                     215
Ser Lys Ser Arg Arg Leu Glu Asn Leu Ile Ala Gln
            220                 225
Leu Pro Gly Glu Lys Lys Asn Gly Leu Phe Gly Asn
    230                 235                     240
Leu Ile Ala Leu Ser Leu Gly Leu Thr Pro Asn Phe
                245                 250
Lys Ser Asn Phe Asp Leu Ala Glu Asp Ala Lys Leu
        255                 260
Gln Leu Ser Lys Asp Thr Tyr Asp Asp Asp Leu Asp
265                 270                     275
Asn Leu Leu Ala Gln Ile Gly Asp Gln Tyr Ala Asp
            280                 285
Leu Phe Leu Ala Ala Lys Asn Leu Ser Asp Ala Ile
    290                 295                     300
Leu Leu Ser Asp Ile Leu Arg Val Asn Thr Glu Ile
                305                 310
Thr Lys Ala Pro Leu Ser Ala Ser Met Ile Lys Arg
        315                 320

Tyr Asp Glu His His Gln Asp Leu Thr Leu Leu Lys
325                 330                 335

Ala Leu Val Arg Gln Gln Leu Pro Glu Lys Tyr Lys
        340                 345

Glu Ile Phe Phe Asp Gln Ser Lys Asn Gly Tyr Ala
350                 355                 360

Gly Tyr Ile Asp Gly Gly Ala Ser Gln Glu Glu Phe
            365                 370

Tyr Lys Phe Ile Lys Pro Ile Leu Glu Lys Met Asp
        375                 380

Gly Thr Glu Glu Leu Leu Val Lys Leu Asn Arg Glu
385                 390                 395

Asp Leu Leu Arg Lys Gln Arg Thr Phe Asp Asn Gly
            400                 405

Ser Ile Pro His Gln Ile His Leu Gly Glu Leu His
410                 415                 420

Ala Ile Leu Arg Arg Gln Glu Asp Phe Tyr Pro Phe
            425                 430

Leu Lys Asp Asn Arg Glu Lys Ile Glu Lys Ile Leu
        435                 440

Thr Phe Arg Ile Pro Tyr Tyr Val Gly Pro Leu Ala
445                 450                 455

Arg Gly Asn Ser Arg Phe Ala Trp Met Thr Arg Lys
            460                 465

Ser Glu Glu Thr Ile Thr Pro Trp Asn Phe Glu Glu
        470                 475                 480

Val Val Asp Lys Gly Ala Ser Ala Gln Ser Phe Ile
            485                 490

Glu Arg Met Thr Asn Phe Asp Lys Asn Leu Pro Asn
            495                 500

Glu Lys Val Leu Pro Lys His Ser Leu Leu Tyr Glu
505                 510                 515

Tyr Phe Thr Val Tyr Asn Glu Leu Thr Lys Val Lys
        520                 525

Tyr Val Thr Glu Gly Met Arg Lys Pro Ala Phe Leu
        530                 535                 540

Ser Gly Glu Gln Lys Lys Ala Ile Val Asp Leu Leu
            545                 550

Phe Lys Thr Asn Arg Lys Val Thr Val Lys Gln Leu
        555                 560

Lys Glu Asp Tyr Phe Lys Lys Ile Glu Cys Phe Asp
565                 570                 575

Ser Val Glu Ile Ser Gly Val Glu Asp Arg Phe Asn
            580                 585

Ala Ser Leu Gly Thr Tyr His Asp Leu Leu Lys Ile
            590                 595                 600

Ile Lys Asp Lys Asp Phe Leu Asp Asn Glu Glu Asn
            605                 610

Glu Asp Ile Leu Glu Asp Ile Val Leu Thr Leu Thr
            615                 620

Leu Phe Glu Asp Arg Glu Met Ile Glu Glu Arg Leu
625                 630                 635

Lys Thr Tyr Ala His Leu Phe Asp Asp Lys Val Met
            640                 645

Lys Gln Leu Lys Arg Arg Arg Tyr Thr Gly Trp Gly
                650                 655                 660

Arg Leu Ser Arg Lys Leu Ile Asn Gly Ile Arg Asp
                    665                 670

Lys Gln Ser Gly Lys Thr Ile Leu Asp Phe Leu Lys
                675                 680

Ser Asp Gly Phe Ala Asn Arg Asn Phe Met Gln Leu
685                 690                 695

Ile His Asp Asp Ser Leu Thr Phe Lys Glu Asp Ile
                700                 705

Gln Lys Ala Gln Val Ser Gly Gln Gly Asp Ser Leu
                710                 715                 720

His Glu His Ile Ala Asn Leu Ala Gly Ser Pro Ala
                    725                 730

Ile Lys Lys Gly Ile Leu Gln Thr Val Lys Val Val
                735                 740

Asp Glu Leu Val Lys Val Met Gly Arg His Lys Pro
745                 750                 755

Glu Asn Ile Val Ile Glu Met Ala Arg Glu Asn Gln
                760                 765

Thr Thr Gln Lys Gly Gln Lys Asn Ser Arg Glu Arg
                770                 775                 780

Met Lys Arg Ile Glu Glu Gly Ile Lys Glu Leu Gly
                    785                 790

Ser Gln Ile Leu Lys Glu His Pro Val Glu Asn Thr
                795                 800

Gln Leu Gln Asn Glu Lys Leu Tyr Leu Tyr Tyr Leu
805                 810                 815

Gln Asn Gly Arg Asp Met Tyr Val Asp Gln Glu Leu
                820                 825

Asp Ile Asn Arg Leu Ser Asp Tyr Asp Val Asp His
                830                 835                 840

Ile Val Pro Gln Ser Phe Leu Lys Asp Ser Ile
                    845                 850

Asp Asn Lys Val Leu Thr Arg Ser Asp Lys Asn Arg
                855                 860

Gly Lys Ser Asp Asn Val Pro Ser Glu Glu Val Val
865                 870                 875

Lys Lys Met Lys Asn Tyr Trp Arg Gln Leu Leu Asn
                880                 885

Ala Lys Leu Ile Thr Gln Arg Lys Phe Asp Asn Leu
                890                 895                 900

Thr Lys Ala Glu Arg Gly Gly Leu Ser Glu Leu Asp
                    905                 910

Lys Ala Gly Phe Ile Lys Arg Gln Leu Val Glu Thr
                915                 920

Arg Gln Ile Thr Lys His Val Ala Gln Ile Leu Asp
925                 930                 935

Ser Arg Met Asn Thr Lys Tyr Asp Glu Asn Asp Lys
                940                 945

Leu Ile Arg Glu Val Lys Val Ile Thr Leu Lys Ser
                950                 955                 960

Lys Leu Val Ser Asp Phe Arg Lys Asp Phe Gln Phe
                965                 970

```
Tyr Lys Val Arg Glu Ile Asn Asn Tyr His His Ala
        975                 980

His Asp Ala Tyr Leu Asn Ala Val Val Gly Thr Ala
985                 990                 995

Leu Ile Lys Lys Tyr Pro Lys Leu Glu Ser Glu Phe
            1000                1005

Val Tyr Gly Asp Tyr Lys Val Tyr Asp Val Arg Lys
        1010            1015            1020

Met Ile Ala Lys Ser Glu Gln Glu Ile Gly Lys Ala
            1025                1030

Thr Ala Lys Tyr Phe Phe Tyr Ser Asn Ile Met Asn
        1035                1040

Phe Phe Lys Thr Glu Ile Thr Leu Ala Asn Gly Glu
1045                1050                1055

Ile Arg Lys Arg Pro Leu Ile Glu Thr Asn Gly Glu
            1060                1065

Thr Gly Glu Ile Val Trp Asp Lys Gly Arg Asp Phe
        1070            1075            1080

Ala Thr Val Arg Lys Val Leu Ser Met Pro Gln Val
            1085                1090

Asn Ile Val Lys Lys Thr Glu Val Gln Thr Gly Gly
            1095                1100

Phe Ser Lys Glu Ser Ile Leu Pro Lys Arg Asn Ser
1105                1110                1115

Asp Lys Leu Ile Ala Arg Lys Lys Asp Trp Asp Pro
            1120                1125

Lys Lys Tyr Gly Gly Phe Asp Ser Pro Thr Val Ala
        1130            1135            1140

Tyr Ser Val Leu Val Val Ala Lys Val Glu Lys Gly
                1145                1150

Lys Ser Lys Lys Leu Lys Ser Val Lys Glu Leu Leu
        1155                1160

Gly Ile Thr Ile Met Glu Arg Ser Ser Phe Glu Lys
1165                1170                1175

Asn Pro Ile Asp Phe Leu Glu Ala Lys Gly Tyr Lys
            1180                1185

Glu Val Lys Lys Asp Leu Ile Ile Lys Leu Pro Lys
        1190            1195            1200

Tyr Ser Leu Phe Glu Leu Glu Asn Gly Arg Lys Arg
                1205                1210

Met Leu Ala Ser Ala Gly Glu Leu Gln Lys Gly Asn
            1215                1220

Glu Leu Ala Leu Pro Ser Lys Tyr Val Asn Phe Leu
1225                1230                1235

Tyr Leu Ala Ser His Tyr Glu Lys Leu Lys Gly Ser
                1240                1245

Pro Glu Asp Asn Glu Gln Lys Gln Leu Phe Val Glu
        1250                1255            1260

Gln His Lys His Tyr Leu Asp Glu Ile Ile Glu Gln
                1265                1270

Ile Ser Glu Phe Ser Lys Arg Val Ile Leu Ala Asp
        1275                1280

Ala Asn Leu Asp Lys Val Leu Ser Ala Tyr Asn Lys
1285                1290                1295

His Arg Asp Lys Pro Ile Arg Glu Gln Ala Glu Asn
                1300                1305

Ile Ile His Leu Phe Thr Leu Thr Asn Leu Gly Ala
        1310                1315            1320

Pro Ala Ala Phe Lys Tyr Phe Asp Thr Thr Ile Asp
                1325                1330

Arg Lys Arg Tyr Thr Ser Thr Lys Glu Val Leu Asp
        1335                1340

Ala Thr Leu Ile His Gln Ser Ile Thr Gly Leu Tyr
1345                1350                1355

Glu Thr Arg Ile Asp Leu Ser Gln Leu Gly Gly Asp
            1360                1365
```

In embodiments, the Cas9 molecule is a *S. pyogenes* Cas9 variant of SEQ ID NO: 6611 that includes one or more mutations to positively charged amino acids (e.g., lysine, arginine or histidine) that introduce an uncharged or nonpolar amino acid, e.g., alanine, at said position. In embodiments, the mutation is to one or more positively charged amino acids in the nt-groove of Cas9. In embodiments, the Cas9 molecule is a *S. pyogenes* Cas9 variant of SEQ ID NO: 6611 that includes a mutation at position 855 of SEQ ID NO: 6611, for example a mutation to an uncharged amino acid, e.g., alanine, at position 855 of SEQ ID NO: 6611. In embodiments, the Cas9 molecule has a mutation only at position 855 of SEQ ID NO: 6611, relative to SEQ ID NO: 6611, e.g., to an uncharged amino acid, e.g., alanine. In embodiments, the Cas9 molecule is a *S. pyogenes* Cas9 variant of SEQ ID NO: 6611 that includes a mutation at position 810, a mutation at position 1003, and/or a mutation at position 1060 of SEQ ID NO: 6611, for example a mutation to alanine at position 810, position 1003, and/or position 1060 of SEQ ID NO: 6611. In embodiments, the Cas9 molecule has a mutation only at position 810, position 1003, and position 1060 of SEQ ID NO: 6611, relative to SEQ ID NO: 6611, e.g., where each mutation is to an uncharged amino acid, for example, alanine. In embodiments, the Cas9 molecule is a *S. pyogenes* Cas9 variant of SEQ ID NO: 6611 that includes a mutation at position 848, a mutation at position 1003, and/or a mutation at position 1060 of SEQ ID NO: 6611, for example a mutation to alanine at position 848, position 1003, and/or position 1060 of SEQ ID NO: 6611. In embodiments, the Cas9 molecule has a mutation only at position 848, position 1003, and position 1060 of SEQ ID NO: 6611, relative to SEQ ID NO: 6611, e.g., where each mutation is to an uncharged amino acid, for example, alanine. In embodiments, the Cas9 molecule is a Cas9 molecule as described in Slaymaker et al., Science Express, available online Dec. 1, 2015 at Science DOI: 10.1126/science.aad5227.

In embodiments, the Cas9 molecule is a *S. pyogenes* Cas9 variant of SEQ ID NO: 6611 that includes one or more mutations. In embodiments, the Cas9 variant comprises a mutation at position 80 of SEQ ID NO: 6611, e.g., includes a leucine at position 80 of SEQ ID NO: 6611 (i.e., comprises, e.g., consists of, SEQ ID NO: 6611 with a C80L mutation). In embodiments, the Cas9 variant comprises a mutation at position 574 of SEQ ID NO: 6611, e.g., includes a glutamic acid at position 574 of SEQ ID NO: 6611 (i.e., comprises, e.g., consists of, SEQ ID NO: 6611 with a C574E mutation). In embodiments, the Cas9 variant comprises a mutation at position 80 and a mutation at position 574 of SEQ ID NO: 6611, e.g., includes a leucine at position 80 of SEQ ID NO: 6611, and a glutamic acid at position 574 of SEQ ID NO: 6611 (i.e., comprises, e.g., consists of, SEQ ID NO: 6611 with a C80L mutation and a C574E mutation). Without being bound by theory, it is believed that such mutations improve the solution properties of the Cas9 molecule.

In embodiments, the Cas9 molecule is a *S. pyogenes* Cas9 variant of SEQ ID NO: 6611 that includes one or more mutations. In embodiments, the Cas9 variant comprises a mutation at position 147 of SEQ ID NO: 6611, e.g., includes a tyrosine at position 147 of SEQ ID NO: 6611 (i.e., comprises, e.g., consists of, SEQ ID NO: 6611 with a D147Y mutation). In embodiments, the Cas9 variant comprises a mutation at position 411 of SEQ ID NO: 6611, e.g., includes a threonine at position 411 of SEQ ID NO: 6611 (i.e., comprises, e.g., consists of, SEQ ID NO: 6611 with a P411T mutation). In embodiments, the Cas9 variant comprises a mutation at position 147 and a mutation at position 411 of SEQ ID NO: 6611, e.g., includes a tyrosine at position 147 of SEQ ID NO: 6611, and a threonine at position 411 of SEQ ID NO: 6611 (i.e., comprises, e.g., consists of, SEQ ID NO: 6611 with a D147Y mutation and a P411T mutation). Without being bound by theory, it is believed that such mutations improve the targeting efficiency of the Cas9 molecule, e.g., in yeast.

In embodiments, the Cas9 molecule is a *S. pyogenes* Cas9 variant of SEQ ID NO: 6611 that includes one or more mutations. In embodiments, the Cas9 variant comprises a mutation at position 1135 of SEQ ID NO: 6611, e.g., includes a glutamic acid at position 1135 of SEQ ID NO: 6611 (i.e., comprises, e.g., consists of, SEQ ID NO: 6611 with a D1135E mutation). Without being bound by theory, it is believed that such mutations improve the selectivity of the Cas9 molecule for the NGG PAM sequence versus the NAG PAM sequence.

In embodiments, the Cas9 molecule is a *S. pyogenes* Cas9 variant of SEQ ID NO: 6611 that includes one or more mutations that introduce an uncharged or nonpolar amino acid, e.g., alanine, at certain positions. In embodiments, the Cas9 molecule is a *S. pyogenes* Cas9 variant of SEQ ID NO: 6611 that includes a mutation at position 497, a mutation at position 661, a mutation at position 695 and/or a mutation at position 926 of SEQ ID NO: 6611, for example a mutation to alanine at position 497, position 661, position 695 and/or position 926 of SEQ ID NO: 6611. In embodiments, the Cas9 molecule has a mutation only at position 497, position 661, position 695, and position 926 of SEQ ID NO: 6611, relative to SEQ ID NO: 6611, e.g., where each mutation is to an uncharged amino acid, for example, alanine. Without being bound by theory, it is believed that such mutations reduce the cutting by the Cas9 molecule at off-target sites It will be understood that the mutations described herein to the Cas9 molecule may be combined, and may be combined with any of the fusions or other modifications described herein, and the Cas9 molecule tested in the assays described herein.

Various types of Cas molecules can be used to practice the inventions disclosed herein. In some embodiments, Cas molecules of Type II Cas systems are used. In other embodiments, Cas molecules of other Cas systems are used. For example, Type I or Type III Cas molecules may be used. Exemplary Cas molecules (and Cas systems) are described, e.g., in Haft et al, PLoS COMPUTATIONAL BIOLOGY 2005, 1(6): e60 and Makarova et al, NATURE REVIEW MICROBIOLOGY 2011, 9:467-477, the contents of both references are incorporated herein by reference in their entirety.

In an embodiment, the Cas9 molecule comprises one or more of the following activities: a nickase activity; a double stranded cleavage activity (e.g., an endonuclease and/or exonuclease activity); a helicase activity; or the ability, together with a gRNA molecule, to localize to a target nucleic acid.

Altered Cas9 Molecules

Naturally occurring Cas9 molecules possess a number of properties, including: nickase activity, nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In an embodiment, a Cas9 molecules can include all or a subset of these properties. In typical embodiments, Cas9 molecules have the ability to interact with a gRNA molecule and, in concert with the gRNA molecule, localize to a site in a nucleic acid. Other activities, e.g., PAM specificity, cleavage activity, or helicase activity can vary more widely in Cas9 molecules.

Cas9 molecules with desired properties can be made in a number of ways, e.g., by alteration of a parental, e.g., naturally occurring Cas9 molecules to provide an altered Cas9 molecule having a desired property. For example, one or more mutations or differences relative to a parental Cas9 molecule can be introduced. Such mutations and differences comprise: substitutions (e.g., conservative substitutions or substitutions of non-essential amino acids); insertions; or deletions. In an embodiment, a Cas9 molecule can comprises one or more mutations or differences, e.g., at least 1, 2, 3, 4, 5, 10, 15, 20, 30, 40 or 50 mutations but less than 200, 100, or 80 mutations relative to a reference Cas9 molecule.

In an embodiment, a mutation or mutations do not have a substantial effect on a Cas9 activity, e.g. a Cas9 activity described herein. In an embodiment, a mutation or mutations have a substantial effect on a Cas9 activity, e.g. a Cas9 activity described herein. In an embodiment, exemplary activities comprise one or more of PAM specificity, cleavage activity, and helicase activity. A mutation(s) can be present, e.g., in: one or more RuvC-like domain, e.g., an N-terminal RuvC-like domain; an HNH-like domain; a region outside the RuvC-like domains and the HNH-like domain. In some embodiments, a mutation(s) is present in an N-terminal RuvC-like domain. In some embodiments, a mutation(s) is present in an HNH-like domain. In some embodiments, mutations are present in both an N-terminal RuvC-like domain and an HNH-like domain.

Whether or not a particular sequence, e.g., a substitution, may affect one or more activity, such as targeting activity, cleavage activity, etc, can be evaluated or predicted, e.g., by evaluating whether the mutation is conservative or by the method described in Section III. In an embodiment, a "non-essential" amino acid residue, as used in the context of a Cas9 molecule, is a residue that can be altered from the wild-type sequence of a Cas9 molecule, e.g., a naturally occurring Cas9 molecule, e.g., an active Cas9 molecule, without abolishing or more preferably, without substantially altering a Cas9 activity (e.g., cleavage activity), whereas changing an "essential" amino acid residue results in a substantial loss of activity (e.g., cleavage activity).

Cas9 Molecules with Altered PAM Recognition or No PAM Recognition

Naturally occurring Cas9 molecules can recognize specific PAM sequences, for example the PAM recognition sequences described above for *S. pyogenes, S. thermophilus, S. mutans, S. aureus* and *N. meningitidis*.

In an embodiment, a Cas9 molecule has the same PAM specificities as a naturally occurring Cas9 molecule. In other embodiments, a Cas9 molecule has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule recognizes to decrease off target sites and/or improve specificity; or eliminate a PAM recognition requirement. In an embodiment, a Cas9 molecule can be altered, e.g., to increase length of PAM recognition sequence and/or improve Cas9 specificity to high level of identity to decrease off target sites and increase specificity. In an embodiment, the length of the PAM recognition sequence is at least 4, 5, 6, 7, 8, 9, 10 or 15 amino acids in length. Cas9 molecules that recognize different PAM sequences and/or have reduced off-target activity can be generated using directed evolution. Exemplary methods and systems that can be used for directed evolution of Cas9 molecules are described, e.g., in Esvelt el al, Nature 2011, 472(7344): 499-503. Candidate Cas9 molecules can be evaluated, e.g., by methods described herein.

Non-Cleaving and Modified-Cleavage Cas9 Molecules

In an embodiment, a Cas9 molecule comprises a cleavage property that differs from naturally occurring Cas9 molecules, e.g., that differs from the naturally occurring Cas9 molecule having the closest homology. For example, a Cas9 molecule can differ from naturally occurring Cas9 molecules, e.g., a Cas9 molecule of S. pyogenes, as follows: its ability to modulate, e.g., decreased or increased, cleavage of a double stranded break (endonuclease and/or exonuclease activity), e.g., as compared to a naturally occurring Cas9 molecule (e.g., a Cas9 molecule of S. pyogenes); its ability to modulate, e.g., decreased or increased, cleavage of a single strand of a nucleic acid, e.g., a non-complimentary strand of a nucleic acid molecule or a complementary strand of a nucleic acid molecule (nickase activity), e.g., as compared to a naturally occurring Cas9 molecule (e.g., a Cas9 molecule of S. pyogenes); or the ability to cleave a nucleic acid molecule, e.g., a double stranded or single stranded nucleic acid molecule, can be eliminated.

Modified Cleavage Active Cas9 Molecules

In an embodiment, an active Cas9 molecule comprises one or more of the following activities: cleavage activity associated with an N-terminal RuvC-like domain; cleavage activity associated with an HNH-like domain; cleavage activity associated with an HNH domain and cleavage activity associated with an N-terminal RuvC-like domain.

In an embodiment, the Cas9 molecule is a Cas9 nickase, e.g., cleaves only a single strand of DNA. In an embodiment, the Cas9 nickase includes a mutation at position 10 and/or a mutation at position 840 of SEQ ID NO: 6611, e.g., comprises a D10A and/or H840A mutation to SEQ ID NO: 6611.

Non-Cleaving Inactive Cas9 Molecules

In an embodiment, the altered Cas9 molecule is an inactive Cas9 molecule which does not cleave a nucleic acid molecule (either double stranded or single stranded nucleic acid molecules) or cleaves a nucleic acid molecule with significantly less efficiency, e.g., less than 20, 10, 5, 1 or 0.1% of the cleavage activity of a reference Cas9 molecule, e.g., as measured by an assay described herein. The reference Cas9 molecule can by a naturally occurring unmodified Cas9 molecule, e.g., a naturally occurring Cas9 molecule such as a Cas9 molecule of S. pyogenes, S. thermophilus, S. aureus or N. meningitidis. In an embodiment, the reference Cas9 molecule is the naturally occurring Cas9 molecule having the closest sequence identity or homology. In an embodiment, the inactive Cas9 molecule lacks substantial cleavage activity associated with an N-terminal RuvC-like domain and cleavage activity associated with an HNH-like domain.

In an embodiment, the Cas9 molecule is dCas9. Tsai et al. (2014), Nat. Biotech. 32:569-577.

A catalytically inactive Cas9 molecule may be fused with a transcription repressor. An inactive Cas9 fusion protein complexes with a gRNA and localizes to a DNA sequence specified by gRNA's targeting domain, but, unlike an active Cas9, it will not cleave the target DNA. Fusion of an effector domain, such as a transcriptional repression domain, to an inactive Cas9 enables recruitment of the effector to any DNA site specified by the gRNA. Site specific targeting of a Cas9 fusion protein to a promoter region of a gene can block or affect polymerase binding to the promoter region, for example, a Cas9 fusion with a transcription factor (e.g., a transcription activator) and/or a transcriptional enhancer binding to the nucleic acid to increase or inhibit transcription activation. Alternatively, site specific targeting of a Cas9– fusion to a transcription repressor to a promoter region of a gene can be used to decrease transcription activation.

Transcription repressors or transcription repressor domains that may be fused to an inactive Cas9 molecule can include ruppel associated box (KRAB or SKD), the Mad mSIN3 interaction domain (SID) or the ERF repressor domain (ERD).

In another embodiment, an inactive Cas9 molecule may be fused with a protein that modifies chromatin. For example, an inactive Cas9 molecule may be fused to heterochromatin protein 1 (HP1), a histone lysine methyltransferase (e.g., SUV39H1, SUV39H2, G9A, ESET/SETDB1, Pr-SET7/8, SUV4-20H 1,RIZ1), a histone lysine demethylates (e.g., LSD1/BHC1 10, SpLsdl/Sw,l/Safl 10, Su(var)3-3, JMJD2A/JHDM3A, JMJD2B, JMJD2C/GASC1, JMJD2D, Rph1, JARID 1 A/RBP2, JARI DIB/PLU-I, JAR1D 1C/SMCX, JARID1 D/SMCY, Lid, Jhn2, Jmj2), a histone lysine deacetylases (e.g., HDAC1, HDAC2, HDAC3, HDAC8, Rpd3, Hos 1, Cir6, HDAC4, HDAC5, HDAC7, HDAC9, Hdal, Cir3, SIRT1, SIRT2, Sir2, Hst1, Hst2, Hst3, Hst4, HDAC11) and a DNA methylases (DNMT1, DNMT2a/DMNT3b, MET1). An inactive Cas9-chromatin modifying molecule fusion protein can be used to alter chromatin status to reduce expression a target gene.

The heterologous sequence (e.g., the transcription repressor domain) may be fused to the N- or C-terminus of the inactive Cas9 protein. In an alternative embodiment, the heterologous sequence (e.g., the transcription repressor domain) may be fused to an internal portion (i.e., a portion other than the N-terminus or C-terminus) of the inactive Cas9 protein.

The ability of a Cas9 molecule/gRNA molecule complex to bind to and cleave a target nucleic acid can be evaluated, e.g., by the methods described herein in Section III. The activity of a Cas9 molecule, e.g., either an active Cas9 or a inactive Cas9, alone or in a complex with a gRNA molecule may also be evaluated by methods well-known in the art, including, gene expression assays and chromatin-based assays, e.g., chromatin immunoprecipitation (ChiP) and chromatin in vivo assay (CiA).

Other Cas9 Molecule Fusions

In embodiments, the Cas9 molecule, e.g, a Cas9 of S. pyogenes, may additionally comprise one or more amino acid sequences that confer additional activity.

In some aspects, the Cas9 molecule may comprise one or more nuclear localization sequences (NLSs), such as at least 1, 2, 3, 4, 5, 6, 7, 8, 9, 10, or more NLSs. In some embodiments, the Cas9 molecule comprises at least 1, 2, 3, 4, 5, 6, 7, 8, 9, 10, or more NLSs at or near the amino-terminus, at least 1, 2, 3, 4, 5, 6, 7, 8, 9, 10, or more NLSs at or near the carboxy-terminus, or a combination of these (e.g. one or more NLS at the amino-terminus and one or more NLS at the carboxy terminus). When more than one NLS is present, each may be selected independently of the others, such that a single NLS may be present in more than one copy and/or in combination with one or more other NLSs present in one or more copies. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Typically, an NLS consists of one or more short sequences of positively charged lysines or arginines exposed on the protein surface, but other types of NLS are known. Non-limiting examples of NLSs include an NLS sequence comprising or derived from: the NLS of the SV40 virus large T-antigen, having the amino acid sequence PKKKRKV (SEQ ID NO: 6612); the NLS from nucleoplasmin (e.g. the nucleoplasmin bipartite NLS with the sequence ICRPAATKKAGQAKICICK. (SEQ ID NO: 6613); the c-myc NLS having the amino acid sequence PAAKRVKLD (SEQ ID NO: 6614) or RQRRNELKRSP (SEQ ID NO: 6615); the hRNPA1 M9 NLS having the sequence NQSSNFGPMKGGNFGGRSSGPYGGGGQYFAKPRNQGGY (SEQ ID NO: 6616); the sequence RMRIZFKNKGKDTAELRRRRVEVSVELRKAKKDEQILKRRNV (SEQ ID NO: 6617) of the IBB domain from importin-alpha; the sequences VSRKRPRP (SEQ ID NO: 6618) and PPKKARED (SEQ ID NO: 6619) of the myoma T protein; the sequence PQPKKKPL (SEQ ID NO: 6620) of human p53; the sequence SALIKKKKKMAP (SEQ ID NO: 6621) of mouse c-abl IV; the sequences DRLRR (SEQ ID NO: 6622) and PKQKKRK (SEQ ID NO: 6623) of the influenza virus NS1; the sequence RKLKKKIKKL (SEQ ID NO: 6624) of the Hepatitis virus delta antigen; the sequence REKKKFLKRR (SEQ ID NO: 6625) of the mouse Mx1 protein; the sequence KRKGDEVDGVDEVAKKKSKK (SEQ ID NO: 6626) of the human poly(ADP-ribose) polymerase; and the sequence RKCLQAGMNLEARKTKK (SEQ ID NO: 6627) of the steroid hormone receptors (human) glucocorticoid. Other suitable NLS sequences are known in the art (e.g., Sorokin, Biochemistry (Moscow) (2007) 72:13, 1439-1457; Lange J Biol Chem. (2007) 282:8, 5101-5).

In some aspects, the Cas9 molecule may comprise one or more amino acid sequences that allow the Cas9 molecule to be specifically recognized, for example a tag. In one embodiment, the tag is a Histidine tag, e.g., a histidine tag comprising at least 3, 4, 5, 6, 7, 8, 9, 10 or more histidine amino acids (SEQ ID NO: 10800). In embodiments, the histidine tag is a His6 tag (six histidines) (SEQ ID NO: 10795). In other embodiments, the histidine tag is a His8 tag (eight histidines). In embodiments, the histidine tag may be separated from one or more other portions of the Cas9 molecule by a linker. In embodiments, the linker is GGS. An example of such a fusion is the Cas9 molecule iProt106520.

In some aspects, the Cas9 molecule may comprise one or more amino acid sequences that are recognized by a protease (e.g., comprise a protease cleavage site). In embodiments, the cleavage site is the tobacco etch virus (TEV) cleavage site, e.g., comprises the sequence ENLYFQG (SEQ ID NO: 7810). In some aspects the protease cleavage site, e.g., the TEV cleavage site is disposed between a tag, e.g., a His tag, e.g., a His6 (SEQ ID NO: 10795) or His8 tag (SEQ ID NO: 10796), and the remainder of the Cas9 molecule. Without being bound by theory it is believed that such introduction will allow for the use of the tag for, e.g., purification of the Cas9 molecule, and then subsequent cleavage so the tag does not interfere with the Cas9 molecule function.

In embodiments, the Cas9 molecule (e.g., a Cas9 molecule as described herein) comprises an N-terminal NLS, and a C-terminal NLS (e.g., comprises, from N- to C-terminal NLS-Cas9-NLS), e.g., wherein each NLS is an SV40 NLS (PKKKRKV (SEQ ID NO: 6612)). In embodiments, the Cas9 molecule (e.g., a Cas9 molecule as described herein) comprises an N-terminal NLS, a C-terminal NLS, and a C-terminal His6 tag (SEQ ID NO: 10795) (e.g., comprises, from N- to C-terminal NLS-Cas9-NLS-His tag), e.g., wherein each NLS is an SV40 NLS (PKKKRKV (SEQ ID NO: 6612)). In embodiments, the Cas9 molecule (e.g., a Cas9 molecule as described herein) comprises an N-terminal His tag (e.g., His6 tag (SEQ ID NO: 10795)), an N-terminal NLS, and a C-terminal NLS (e.g., comprises, from N- to C-terminal His tag-NLS-Cas9-NLS), e.g., wherein each NLS is an SV40 NLS (PKKKRKV (SEQ ID NO: 6612)). In embodiments, the Cas9 molecule (e.g., a Cas9 molecule as described herein) comprises an N-terminal NLS and a C-terminal His tag (e.g., His6 tag (SEQ ID NO: 10795)) (e.g., comprises from N- to C-terminal His tag-Cas9-NLS), e.g., wherein the NLS is an SV40 NLS (PKKKRKV (SEQ ID NO: 6612)). In embodiments, the Cas9 molecule (e.g., a Cas9 molecule as described herein) comprises an N-terminal His tag (e.g., His6 tag (SEQ ID NO: 10795)) and a C-terminal NLS (e.g., comprises from N- to C-terminal NLS-Cas9-His tag), e.g., wherein the NLS is an SV40 NLS (PKKKRKV (SEQ ID NO: 6612)). In embodiments, the Cas9 molecule (e.g., a Cas9 molecule as described herein) comprises an N-terminal His tag (e.g., His8 tag (SEQ ID NO: 10796)), an N-terminal cleavage domain (e.g., a tobacco etch virus (TEV) cleavage domain (e.g., comprises the sequence ENLYFQG (SEQ ID NO: 7810))), an N-terminal NLS (e.g., an SV40 NLS; SEQ ID NO: 6612), and a C-terminal NLS (e.g., an SV40 NLS; SEQ ID NO: 6612) (e.g., comprises from N- to C-terminal His tag-TEV-NLS-Cas9-NLS). In any of the aforementioned embodiments the Cas9 has the sequence of SEQ ID NO: 6611. Alternatively, in any of the aforementioned embodiments, the Cas9 has a sequence of a Cas9 variant of SEQ ID NO: 6611, e.g., as described herein. In any of the aforementioned embodiments, the Cas9 molecule comprises a linker between the His tag and another portion of the molecule, e.g., a GGS linker. Amino acid sequences of exemplary Cas9 molecules described above are provided below. "iProt" identifiers match those in FIG. 60.

```
iProt105026 (also referred to as iProt106154, iProt106331, iProt106545,
and PID426303, depending on the preparation of the protein) (SEQ ID NO: 7821):
MAPKKKRKVD KKYSIGLDIG TNSVGWAVIT DEYKVPSKKF KVLGNTDRHS IKKNLIGALL

FDSGETAEAT RLKRTARRRY TRRKNRICYL QEIFSNEMAK VDDSFFHRLE ESFLVEEDKK
```

```
HERHPIFGNI VDEVAYHEKY PTIYHLRKKL VDSTDKADLR LIYLALAHMI KFRGHFLIEG
DLNPDNSDVD KLFIQLVQTY NQLFEENPIN ASGVDAKAIL SARLSKSRRL ENLIAQLPGE
KKNGLFGNLI ALSLGLTPNF KSNFDLAEDA KLQLSKDTYD DDLDNLLAQI GDQYADLFLA
AKNLSDAILL SDILRVNTEI TKAPLSASMI KRYDEHHQDL TLLKALVRQQ LPEKYKEIFF
DQSKNGYAGY IDGGASQEEF YKFIKPILEK MDGTEELLVK LNREDLLRKQ RTFDNGSIPH
QIHLGELHAI LRRQEDFYPF LKDNREKIEK ILTFRIPYYV GPLARGNSRF AWMTRKSEET
ITPWNFEEVV DKGASAQSFI ERMTNFDKNL PNEKVLPKHS LLYEYFTVYN ELTKVKYVTE
GMRKPAFLSG EQKKAIVDLL FKTNRKVTVK QLKEDYFKKI ECFDSVEISG VEDRFNASLG
TYHDLLKIIK DKDFLDNEEN EDILEDIVLT LTLFEDREMI EERLKTYAHL FDDKVMKQLK
RRRYTGWGRL SRKLINGIRD KQSGKTILDF LKSDGFANRN FMQLIHDDSL TFKEDIQKAQ
VSGQGDSLHE HIANLAGSPA IKKGILQTVK VVDELVKVMG RHKPENIVIE MARENQTTQK
GQKNSRERMK RIEEGIKELG SQILKEHPVE NTQLQNEKLY LYYLQNGRDM YVDQELDINR
LSDYDVDHIV PQSFLKDDSI DNKVLTRSDK NRGKSDNVPS EEVVKKMKNY WRQLLNAKLI
TQRKFDNLTK AERGGLSELD KAGFIKRQLV ETRQITKHVA QILDSRMNTK YDENDKLIRE
VKVITLKSKL VSDFRKDFQF YKVREINNYH HAHDAYLNAV VGTALIKKYP KLESEFVYGD
YKVYDVRKMI AKSEQEIGKA TAKYFFYSNI MNFFKTEITL ANGEIRKRPL IETNGETGEI
VWDKGRDFAT VRKVLSMPQV NIVKKTEVQT GGFSKESILP KRNSDKLIAR KKDWDPKKYG
GFDSPTVAYS VLVVAKVEKG KSKKLKSVKE LLGITIMERS SFEKNPIDFL EAKGYKEVKK
DLIIKLPKYS LFELENGRKR MLASAGELQK GNELALPSKY VNFLYLASHY EKLKGSPEDN
EQKQLFVEQH KHYLDEIIEQ ISEFSKRVIL ADANLDKVLS AYNKHRDKPI REQAENIIHL
FTLTNLGAPA AFKYFDTTID RKRYTSTKEV LDATLIHQSI TGLYETRIDL SQLGGDSRAD
PKKKRKVHHH HHH iProt106518 (SEQ ID NO: 7822):
MAPKKKRKVD KKYSIGLDIG TNSVGWAVIT DEYKVPSKKF KVLGNTDRHS IKKNLIGALL
FDSGETAEAT RLKRTARRRY TRRKNRILYL QEIFSNEMAK VDDSFFHRLE ESFLVEEDKK
HERHPIFGNI VDEVAYHEKY PTIYHLRKKL VDSTDKADLR LIYLALAHMI KFRGHFLIEG
DLNPDNSDVD KLFIQLVQTY NQLFEENPIN ASGVDAKAIL SARLSKSRRL ENLIAQLPGE
KKNGLFGNLI ALSLGLTPNF KSNFDLAEDA KLQLSKDTYD DDLDNLLAQI GDQYADLFLA
AKNLSDAILL SDILRVNTEI TKAPLSASMI KRYDEHHQDL TLLKALVRQQ LPEKYKEIFF
DQSKNGYAGY IDGGASQEEF YKFIKPILEK MDGTEELLVK LNREDLLRKQ RTFDNGSIPH
QIHLGELHAI LRRQEDFYPF LKDNREKIEK ILTFRIPYYV GPLARGNSRF AWMTRKSEET
ITPWNFEEVV DKGASAQSFI ERMTNFDKNL PNEKVLPKHS LLYEYFTVYN ELTKVKYVTE
GMRKPAFLSG EQKKAIVDLL FKTNRKVTVK QLKEDYFKKI EEFDSVEISG VEDRFNASLG
TYHDLLKIIK DKDFLDNEEN EDILEDIVLT LTLFEDREMI EERLKTYAHL FDDKVMKQLK
RRRYTGWGRL SRKLINGIRD KQSGKTILDF LKSDGFANRN FMQLIHDDSL TFKEDIQKAQ
VSGQGDSLHE HIANLAGSPA IKKGILQTVK VVDELVKVMG RHKPENIVIE MARENQTTQK
GQKNSRERMK RIEEGIKELG SQILKEHPVE NTQLQNEKLY LYYLQNGRDM YVDQELDINR
LSDYDVDHIV PQSFLKDDSI DNKVLTRSDK NRGKSDNVPS EEVVKKMKNY WRQLLNAKLI
TQRKFDNLTK AERGGLSELD KAGFIKRQLV ETRQITKHVA QILDSRMNTK YDENDKLIRE
VKVITLKSKL VSDFRKDFQF YKVREINNYH HAHDAYLNAV VGTALIKKYP KLESEFVYGD
YKVYDVRKMI AKSEQEIGKA TAKYFFYSNI MNFFKTEITL ANGEIRKRPL IETNGETGEI
```

-continued

```
VWDKGRDFAT VRKVLSMPQV NIVKKTEVQT GGFSKESILP KRNSDKLIAR KKDWDPKKYG

GFDSPTVAYS VLVVAKVEKG KSKKLKSVKE LLGITIMERS SFEKNPIDFL EAKGYKEVKK

DLIIKLPKYS LFELENGRKR MLASAGELQK GNELALPSKY VNFLYLASHY EKLKGSPEDN

EQKQLFVEQH KHYLDEIIEQ ISEFSKRVIL ADANLDKVLS AYNKHRDKPI REQAENIIHL

FTLTNLGAPA AFKYFDTTID RKRYTSTKEV LDATLIHQSI TGLYETRIDL SQLGGDSRAD

PKKKRKVHHH HHH iProt106519 (SEQ ID NO: 7823):
MGSSHHHHHH HHENLYFQGS MDKKYSIGLD IGTNSVGWAV ITDEYKVPSK KFKVLGNTDR

HSIKKNLIGA LLFDSGETAE ATRLKRTARR RYTRRKNRIC YLQEIFSNEM AKVDDSFFHR

LEESFLVEED KKHERHPIFG NIVDEVAYHE KYPTIYHLRK KLVDSTDKAD LRLIYLALAH

MIKFRGHFLI EGDLNPDNSD VDKLFIQLVQ TYNQLFEENP INASGVDAKA ILSARLSKSR

RLENLIAQLP GEKKNGLFGN LIALSLGLTP NFKSNFDLAE DAKLQLSKDT YDDDLDNLLA

QIGDQYADLF LAAKNLSDAI LLSDILRVNT EITKAPLSAS MIKRYDEHHQ DLTLLKALVR

QQLPEKYKEI FFDQSKNGYA GYIDGGASQE EFYKFIKPIL EKMDGTEELL VKLNREDLLR

KQRTFDNGSI PHQIHLGELH AILRRQEDFY PFLKDNREKI EKILTFRIPY YVGPLARGNS

RFAWMTRKSE ETITPWNFEE VVDKGASAQS FIERMTNFDK NLPNEKVLPK HSLLYEYFTV

YNELTKVKYV TEGMRKPAFL SGEQKKAIVD LLFKTNRKVT VKQLKEDYFK KIECFDSVEI

SGVEDRFNAS LGTYHDLLKI IKDKDFLDNE ENEDILEDIV LTLTLFEDRE MIEERLKTYA

HLFDDKVMKQ LKRRRYTGWG RLSRKLINGI RDKQSGKTIL DFLKSDGFAN RNFMQLIHDD

SLTFKEDIQK AQVSGQGDSL HEHIANLAGS PAIKKGILQT VKVVDELVKV MGRHKPENIV

IEMARENQTT QKGQKNSRER MKRIEEGIKE LGSQILKEHP VENTQLQNEK LYLYYLQNGR

DMYVDQELDI NRLSDYDVDH IVPQSFLKDD SIDNKVLTRS DKNRGKSDNV PSEEVVKKMK

NYWRQLLNAK LITQRKFDNL TKAERGGLSE LDKAGFIKRQ LVETRQITKH VAQILDSRMN

TKYDENDKLI REVKVITLKS KLVSDFRKDF QFYKVREINN YHHAHDAYLN AVVGTALIKK

YPKLESEFVY GDYKVYDVRK MIAKSEQEIG KATAKYFFYS NIMNFFKTEI TLANGEIRKR

PLIETNGETG EIVWDKGRDF ATVRKVLSMP QVNIVKKTEV QTGGFSKESI LPKRNSDKLI

ARKKDWDPKK YGGFDSPTVA YSVLVVAKVE KGKSKKLKSV KELLGITIME RSSFEKNPID

FLEAKGYKEV KKDLIIKLPK YSLFELENGR KRMLASAGEL QKGNELALPS KYVNFLYLAS

HYEKLKGSPE DNEQKQLFVE QHKHYLDEII EQISEFSKRV ILADANLDKV LSAYNKHRDK

PIREQAENII HLFTLTNLGA PAAFKYFDTT IDRKRYTSTK EVLDATLIHQ SITGLYETRI

DLSQLGGDGG GSPKKKRKV iProt106520 (SEQ ID NO: 7824):
MAHHHHHHGG SPKKKRKVDK KYSIGLDIGT NSVGWAVITD EYKVPSKKFK VLGNTDRHSI

KKNLIGALLF DSGETAEATR LKRTARRRYT RRKNRICYLQ EIFSNEMAKV DDSFFHRLEE

SFLVEEDKKH ERHPIFGNIV DEVAYHEKYP TIYHLRKKLV DSTDKADLRL IYLALAHMIK

FRGHFLIEGD LNPDNSDVDK LFIQLVQTYN QLFEENPINA SGVDAKAILS ARLSKSRRLE

NLIAQLPGEK KNGLFGNLIA LSLGLTPNFK SNFDLAEDAK LQLSKDTYDD DLDNLLAQIG

DQYADLFLAA KNLSDAILLS DILRVNTEIT KAPLSASMIK RYDEHHQDLT LLKALVRQQL

PEKYKEIFFD QSKNGYAGYI DGGASQEEFY KFIKPILEKM DGTEELVKL NREDLLRKQR

TFDNGSIPHQ IHLGELHAIL RRQEDFYPFL KDNREKIEKI LTFRIPYYVG PLARGNSRFA

WMTRKSEETI TPWNFEEVVD KGASAQSFIE RMTNFDKNLP NEKVLPKHSL LYEYFTVYNE

LTKVKYVTEG MRKPAFLSGE QKKAIVDLLF KTNRKVTVKQ LKEDYFKKIE CFDSVEISGV
```

```
EDRFNASLGT YHDLLKIIKD KDFLDNEENE DILEDIVLTL TLFEDREMIE ERLKTYAHLF

DDKVMKQLKR RRYTGWGRLS RKLINGIRDK QSGKTILDFL KSDGFANRNF MQLIHDDSLT

FKEDIQKAQV SGQGDSLHEH IANLAGSPAI KKGILQTVKV VDELVKVMGR HKPENIVIEM

ARENQTTQKG QKNSRERMKR IEEGIKELGS QILKEHPVEN TQLQNEKLYL YYLQNGRDMY

VDQELDINRL SDYDVDHIVP QSFLKDDSID NKVLTRSDKN RGKSDNVPSE EVVKKMKNYW

RQLLNAKLIT QRKFDNLTKA ERGGLSELDK AGFIKRQLVE TRQITKHVAQ ILDSRMNTKY

DENDKLIREV KVITLKSKLV SDFRKDFQFY KVREINNYHH AHDAYLNAVV GTALIKKYPK

LESEFVYGDY KVYDVRKMIA KSEQEIGKAT AKYFFYSNIM NFFKTEITLA NGEIRKRPLI

ETNGETGEIV WDKGRDFATV RKVLSMPQVN IVKKTEVQTG GFSKESILPK RNSDKLIARK

KDWDPKKYGG FDSPTVAYSV LVVAKVEKGK SKKLKSVKEL LGITIMERSS FEKNPIDFLE

AKGYKEVKKD LIIKLPKYSL FELENGRKRM LASAGELQKG NELALPSKYV NFLYLASHYE

KLKGSPEDNE QKQLFVEQHK HYLDEIIEQI SEFSKRVILA DANLDKVLSA YNKHRDKPIR

EQAENIIHLF TLTNLGAPAA FKYFDTTIDR KRYTSTKEVL DATLIHQSIT GLYETRIDLS

QLGGDSRADP KKKRKV iProt106521 (SEQ ID NO: 7825):
MAPKKKRKVD KKYSIGLDIG TNSVGWAVIT DEYKVPSKKF KVLGNTDRHS IKKNLIGALL

FDSGETAEAT RLKRTARRRY TRRKNRICYL QEIFSNEMAK VDDSFFHRLE ESFLVEEDKK

HERHPIFGNI VDEVAYHEKY PTIYHLRKKL VDSTDKADLR LIYLALAHMI KFRGHFLIEG

DLNPDNSDVD KLFIQLVQTY NQLFEENPIN ASGVDAKAIL SARLSKSRRL ENLIAQLPGE

KKNGLFGNLI ALSLGLTPNF KSNFDLAEDA KLQLSKDTYD DDLDNLLAQI GDQYADLFLA

AKNLSDAILL SDILRVNTEI TKAPLSASMI KRYDEHHQDL TLLKALVRQQ LPEKYKEIFF

DQSKNGYAGY IDGGASQEEF YKFIKPILEK MDGTEELLVK LNREDLLRKQ RTFDNGSIPH

QIHLGELHAI LRRQEDFYPF LKDNREKIEK ILTFRIPYYV GPLARGNSRF AWMTRKSEET

ITPWNFEEVV DKGASAQSFI ERMTNFDKNL PNEKVLPKHS LLYEYFTVYN ELTKVKYVTE

GMRKPAFLSG EQKKAIVDLL FKTNRKVTVK QLKEDYFKKI ECFDSVEISG VEDRFNASLG

TYHDLLKIIK DKDFLDNEEN EDILEDIVLT LTLFEDREMI EERLKTYAHL FDDKVMKQLK

RRRYTGWGRL SRKLINGIRD KQSGKTILDF LKSDGFANRN FMQLIHDDSL TFKEDIQKAQ

VSGQGDSLHE HIANLAGSPA IKKGILQTVK VVDELVKVMG RHKPENIVIE MARENQTTQK

GQKNSRERMK RIEEGIKELG SQILKEHPVE NTQLQNEKLY LYYLQNGRDM YVDQELDINR

LSDYDVDHIV PQSFLKDDSI DNKVLTRSDK NRGKSDNVPS EEVVKKMKNY WRQLLNAKLI

TQRKFDNLTK AERGGLSELD KAGFIKRQLV ETRQITKHVA QILDSRMNTK YDENDKLIRE

VKVITLKSKL VSDFRKDFQF YKVREINNYH AHDAYLNAV VGTALIKKYP KLESEFVYGD

YKVYDVRKMI AKSEQEIGKA TAKYFFYSNI MNFFKTEITL ANGEIRKRPL IETNGETGEI

VWDKGRDFAT VRKVLSMPQV NIVKKTEVQT GGFSKESILP KRNSDKLIAR KKDWDPKKYG

GFDSPTVAYS VLVVAKVEKG KSKKLKSVKE LLGITIMERS SFEKNPIDFL EAKGYKEVKK

DLIIKLPKYS LFELENGRKR MLASAGELQK GNELALPSKY VNFLYLASHY EKLKGSPEDN

EQKQLFVEQH KHYLDEIIEQ ISEFSKRVIL ADANLDKVLS AYNKHRDKPI REQAENIIHL

FTLTNLGAPA AFKYFDTTID RKRYTSTKEV LDATLIHQSI TGLYETRIDL SQLGGDSRAD

HHHHHH
``` iProt106522 (SEQ ID NO: 7826):
MAHHHHHGG SDKKYSIGLD IGTNSVGWAV ITDEYKVPSK KFKVLGNTDR HSIKKNLIGA

LLFDSGETAE ATRLKRTARR RYTRRKNRIC YLQEIFSNEM AKVDDSFFHR LEESFLVEED

KKHERHPIFG NIVDEVAYHE KYPTIYHLRK KLVDSTDKAD LRLIYLALAH MIKFRGHFLI

EGDLNPDNSD VDKLFIQLVQ TYNQLFEENP INASGVDAKA ILSARLSKSR RLENLIAQLP

GEKKNGLFGN LIALSLGLTP NFKSNFDLAE DAKLQLSKDT YDDDLDNLLA QIGDQYADLF

LAAKNLSDAI LLSDILRVNT EITKAPLSAS MIKRYDEHHQ DLTLLKALVR QQLPEKYKEI

FFDQSKNGYA GYIDGGASQE EFYKFIKPIL EKMDGTEELL VKLNREDLLR KQRTFDNGSI

PHQIHLGELH AILRRQEDFY PFLKDNREKI EKILTFRIPY YVGPLARGNS RFAWMTRKSE

ETITPWNFEE VVDKGASAQS FIERMTNFDK NLPNEKVLPK HSLLYEYFTV YNELTKVKYV

TEGMRKPAFL SGEQKKAIVD LLFKTNRKVT VKQLKEDYFK KIECFDSVEI SGVEDRFNAS

LGTYHDLLKI IKDKDFLDNE ENEDILEDIV LTLTLFEDRE MIEERLKTYA HLFDDKVMKQ

LKRRRYTGWG RLSRKLINGI RDKQSGKTIL DFLKSDGFAN RNFMQLIHDD SLTFKEDIQK

AQVSGQGDSL HEHIANLAGS PAIKKGILQT VKVVDELVKV MGRHKPENIV IEMARENQTT

QKGQKNSRER MKRIEEGIKE LGSQILKEHP VENTQLQNEK LYLYYLQNGR DMYVDQELDI

NRLSDYDVDH IVPQSFLKDD SIDNKVLTRS DKNRGKSDNV PSEEVVKKMK NYWRQLLNAK

LITQRKFDNL TKAERGGLSE LDKAGFIKRQ LVETRQITKH VAQILDSRMN TKYDENDKLI

REVKVITLKS KLVSDFRKDF QFYKVREINN YHHAHDAYLN AVVGTALIKK YPKLESEFVY

GDYKVYDVRK MIAKSEQEIG KATAKYFFYS NIMNFFKTEI TLANGEIRKR PLIETNGETG

EIVWDKGRDF ATVRKVLSMP QVNIVKKTEV QTGGFSKESI LPKRNSDKLI ARKKDWDPKK

YGGFDSPTVA YSVLVVAKVE KGKSKKLKSV KELLGITIME RSSFEKNPID FLEAKGYKEV

KKDLIIKLPK YSLFELENGR KRMLASAGEL QKGNELALPS KYVNFLYLAS HYEKLKGSPE

DNEQKQLFVE QHKHYLDEII EQISEFSKRV ILADANLDKV LSAYNKHRDK PIREQAENII

HLFTLTNLGA PAAFKYFDTT IDRKRYTSTK EVLDATLIHQ SITGLYETRI DLSQLGGDSR

ADPKKKRKV iProt106658 (SEQ ID NO: 7827):
MGSSHHHHHH HHENLYFQGS MDKKYSIGLD IGTNSVGWAV ITDEYKVPSK KFKVLGNTDR

HSIKKNLIGA LLFDSGETAE ATRLKRTARR RYTRRKNRIC YLQEIFSNEM AKVDDSFFHR

LEESFLVEED KKHERHPIFG NIVDEVAYHE KYPTIYHLRK KLVDSTDKAD LRLIYLALAH

MIKFRGHFLI EGDLNPDNSD VDKLFIQLVQ TYNQLFEENP INASGVDAKA ILSARLSKSR

RLENLIAQLP GEKKNGLFGN LIALSLGLTP NFKSNFDLAE DAKLQLSKDT YDDDLDNLLA

QIGDQYADLF LAAKNLSDAI LLSDILRVNT EITKAPLSAS MIKRYDEHHQ DLTLLKALVR

QQLPEKYKEI FFDQSKNGYA GYIDGGASQE EFYKFIKPIL EKMDGTEELL VKLNREDLLR

KQRTFDNGSI PHQIHLGELH AILRRQEDFY PFLKDNREKI EKILTFRIPY YVGPLARGNS

RFAWMTRKSE ETITPWNFEE VVDKGASAQS FIERMTNFDK NLPNEKVLPK HSLLYEYFTV

YNELTKVKYV TEGMRKPAFL SGEQKKAIVD LLFKTNRKVT VKQLKEDYFK KIECFDSVEI

SGVEDRFNAS LGTYHDLLKI IKDKDFLDNE ENEDILEDIV LTLTLFEDRE MIEERLKTYA

HLFDDKVMKQ LKRRRYTGWG RLSRKLINGI RDKQSGKTIL DFLKSDGFAN RNFMQLIHDD

SLTFKEDIQK AQVSGQGDSL HEHIANLAGS PAIKKGILQT VKVVDELVKV MGRHKPENIV

IEMARENQTT QKGQKNSRER MKRIEEGIKE LGSQILKEHP VENTQLQNEK LYLYYLQNGR

DMYVDQELDI NRLSDYDVDH IVPQSFLKDD SIDNKVLTRS DKNRGKSDNV PSEEVVKKMK

-continued

NYWRQLLNAK LITQRKFDNL TKAERGGLSE LDKAGFIKRQ LVETRQITKH VAQILDSRMN

TKYDENDKLI REVKVITLKS KLVSDFRKDF QFYKVREINN YHHAHDAYLN AVVGTALIKK

YPKLESEFVY GDYKVYDVRK MIAKSEQEIG KATAKYFFYS NIMNFFKTEI TLANGEIRKR

PLIETNGETG EIVWDKGRDF ATVRKVLSMP QVNIVKKTEV QTGGFSKESI LPKRNSDKLI

ARKKDWDPKK YGGFDSPTVA YSVLVVAKVE KGKSKKLKSV KELLGITIME RSSFEKNPID

FLEAKGYKEV KKDLIIKLPK YSLFELENGR KRMLASAGEL QKGNELALPS KYVNFLYLAS

HYEKLKGSPE DNEQKQLFVE QHKHYLDEII EQISEFSKRV ILADANLDKV LSAYNKHRDK

PIREQAENII HLFTLTNLGA PAAFKYFDTT IDRKRYTSTK EVLDATLIHQ SITGLYETRI

DLSQLGGDGG GSPKKKRKV iProt106745 (SEQ ID NO: 7828):
MAPKKKRKVD KKYSIGLDIG TNSVGWAVIT DEYKVPSKKF KVLGNTDRHS IKKNLIGALL

FDSGETAEAT RLKRTARRRY TRRKNRICYL QEIFSNEMAK VDDSFFHRLE ESFLVEEDKK

HERHPIFGNI VDEVAYHEKY PTIYHLRKKL VDSTDKADLR LIYLALAHMI KFRGHFLIEG

DLNPDNSDVD KLFIQLVQTY NQLFEENPIN ASGVDAKAIL SARLSKSRRL ENLIAQLPGE

KKNGLFGNLI ALSLGLTPNF KSNFDLAEDA KLQLSKDTYD DDLDNLLAQI GDQYADLFLA

AKNLSDAILL SDILRVNTEI TKAPLSASMI KRYDEHHQDL TLLKALVRQQ LPEKYKEIFF

DQSKNGYAGY IDGGASQEEF YKFIKPILEK MDGTEELLVK LNREDLLRKQ RTFDNGSIPH

QIHLGELHAI LRRQEDFYPF LKDNREKIEK ILTFRIPYYV GPLARGNSRF AWMTRKSEET

ITPWNFEEVV DKGASAQSFI ERMTNFDKNL PNEKVLPKHS LLYEYFTVYN ELTKVKYVTE

GMRKPAFLSG EQKKAIVDLL FKTNRKVTVK QLKEDYFKKI ECFDSVEISG VEDRFNASLG

TYHDLLKIIK DKDFLDNEEN EDILEDIVLT LTLFEDREMI EERLKTYAHL FDDKVMKQLK

RRRYTGWGRL SRKLINGIRD KQSGKTILDF LKSDGFANRN FMQLIHDDSL TFKEDIQKAQ

VSGQGDSLHE HIANLAGSPA IKKGILQTVK VVDELVKVMG RHKPENIVIE MARENQTTQK

GQKNSRERMK RIEEGIKELG SQILKEHPVE NTQLQNEKLY LYYLQNGRDM YVDQELDINR

LSDYDVDHIV PQSFLKDDSI DNAVLTRSDK NRGKSDNVPS EEVVKKMKNY WRQLLNAKLI

TQRKFDNLTK AERGGLSELD KAGFIKRQLV ETRQITKHVA QILDSRMNTK YDENDKLIRE

VKVITLKSKL VSDFRKDFQF YKVREINNYH HAHDAYLNAV VGTALIKKYP KLESEFVYGD

YKVYDVRKMI AKSEQEIGKA TAKYFFYSNI MNFFKTEITL ANGEIRKRPL IETNGETGEI

VWDKGRDFAT VRKVLSMPQV NIVKKTEVQT GGFSKESILP KRNSDKLIAR KKDWDPKKYG

GFDSPTVAYS VLVVAKVEKG KSKKLKSVKE LLGITIMERS SFEKNPIDFL EAKGYKEVKK

DLIIKLPKYS LFELENGRKR MLASAGELQK GNELALPSKY VNFLYLASHY EKLKGSPEDN

EQKQLFVEQH KHYLDEIIEQ ISEFSKRVIL ADANLDKVLS AYNKHRDKPI REQAENIIHL

FTLTNLGAPA AFKYFDTTID RKRYTSTKEV LDATLIHQSI TGLYETRIDL SQLGGDSRAD

PKKKRKVHHH HHH iProt106746 (SEQ ID NO: 7829):
MAPKKKRKVD KKYSIGLDIG TNSVGWAVIT DEYKVPSKKF KVLGNTDRHS IKKNLIGALL

FDSGETAEAT RLKRTARRRY TRRKNRICYL QEIFSNEMAK VDDSFFHRLE ESFLVEEDKK

HERHPIFGNI VDEVAYHEKY PTIYHLRKKL VDSTDKADLR LIYLALAHMI KFRGHFLIEG

DLNPDNSDVD KLFIQLVQTY NQLFEENPIN ASGVDAKAIL SARLSKSRRL ENLIAQLPGE

KKNGLFGNLI ALSLGLTPNF KSNFDLAEDA KLQLSKDTYD DDLDNLLAQI GDQYADLFLA

AKNLSDAILL SDILRVNTEI TKAPLSASMI KRYDEHHQDL TLLKALVRQQ LPEKYKEIFF

DQSKNGYAGY IDGGASQEEF YKFIKPILEK MDGTEELLVK LNREDLLRKQ RTFDNGSIPH

```
QIHLGELHAI LRRQEDFYPF LKDNREKIEK ILTFRIPYYV GPLARGNSRF AWMTRKSEET

ITPWNFEEVV DKGASAQSFI ERMTNFDKNL PNEKVLPKHS LLYEYFTVYN ELTKVKYVTE

GMRKPAFLSG EQKKAIVDLL FKTNRKVTVK QLKEDYFKKI ECFDSVEISG VEDRFNASLG

TYHDLLKIIK DKDFLDNEEN EDILEDIVLT LTLFEDREMI EERLKTYAHL FDDKVMKQLK

RRRYTGWGRL SRKLINGIRD KQSGKTILDF LKSDGFANRN FMQLIHDDSL TFKEDIQKAQ

VSGQGDSLHE HIANLAGSPA IKKGILQTVK VVDELVKVMG RHKPENIVIE MARENQTTQK

GQKNSRERMK RIEEGIKELG SQILKEHPVE NTQLQNEALY LYYLQNGRDM YVDQELDINR

LSDYDVDHIV PQSFLKDDSI DNKVLTRSDK NRGKSDNVPS EEVVKKMKNY WRQLLNAKLI

TQRKFDNLTK AERGGLSELD KAGFIKRQLV ETRQITKHVA QILDSRMNTK YDENDKLIRE

VKVITLKSKL VSDFRKDFQF YKVREINNYH HAHDAYLNAV VGTALIKKYP ALESEFVYGD

YKVYDVRKMI AKSEQEIGKA TAKYFFYSNI MNFFKTEITL ANGEIRKAPL IETNGETGEI

VWDKGRDFAT VRKVLSMPQV NIVKKTEVQT GGFSKESILP KRNSDKLIAR KKDWDPKKYG

GFDSPTVAYS VLVVAKVEKG KSKKLKSVKE LLGITIMERS SFEKNPIDFL EAKGYKEVKK

DLIIKLPKYS LFELENGRKR MLASAGELQK GNELALPSKY VNFLYLASHY EKLKGSPEDN

EQKQLFVEQH KHYLDEIIEQ ISEFSKRVIL ADANLDKVLS AYNKHRDKPI REQAENIIHL

FTLTNLGAPA AFKYFDTTID RKRYTSTKEV LDATLIHQSI TGLYETRIDL SQLGGDSRAD

PKKKRKVHHH HHH iProt106747 (SEQ ID NO: 7830):
MAPKKKRKVD KKYSIGLDIG TNSVGWAVIT DEYKVPSKKF KVLGNTDRHS IKKNLIGALL

FDSGETAEAT RLKRTARRRY TRRKNRICYL QEIFSNEMAK VDDSFFHRLE ESFLVEEDKK

HERHPIFGNI VDEVAYHEKY PTIYHLRKKL VDSTDKADLR LIYLALAHMI KFRGHFLIEG

DLNPDNSDVD KLFIQLVQTY NQLFEENPIN ASGVDAKAIL SARLSKSRRL ENLIAQLPGE

KKNGLFGNLI ALSLGLTPNF KSNFDLAEDA KLQLSKDTYD DDLDNLLAQI GDQYADLFLA

AKNLSDAILL SDILRVNTEI TKAPLSASMI KRYDEHHQDL TLLKALVRQQ LPEKYKEIFF

DQSKNGYAGY IDGGASQEEF YKFIKPILEK MDGTEELLVK LNREDLLRKQ RTFDNGSIPH

QIHLGELHAI LRRQEDFYPF LKDNREKIEK ILTFRIPYYV GPLARGNSRF AWMTRKSEET

ITPWNFEEVV DKGASAQSFI ERMTNFDKNL PNEKVLPKHS LLYEYFTVYN ELTKVKYVTE

GMRKPAFLSG EQKKAIVDLL FKTNRKVTVK QLKEDYFKKI ECFDSVEISG VEDRFNASLG

TYHDLLKIIK DKDFLDNEEN EDILEDIVLT LTLFEDREMI EERLKTYAHL FDDKVMKQLK

RRRYTGWGRL SRKLINGIRD KQSGKTILDF LKSDGFANRN FMQLIHDDSL TFKEDIQKAQ

VSGQGDSLHE HIANLAGSPA IKKGILQTVK VVDELVKVMG RHKPENIVIE MARENQTTQK

GQKNSRERMK RIEEGIKELG SQILKEHPVE NTQLQNEKLY LYYLQNGRDM YVDQELDINR

LSDYDVDHIV PQSFLADDSI DNKVLTRSDK NRGKSDNVPS EEVVKKMKNY WRQLLNAKLI

TQRKFDNLTK AERGGLSELD KAGFIKRQLV ETRQITKHVA QILDSRMNTK YDENDKLIRE

VKVITLKSKL VSDFRKDFQF YKVREINNYH HAHDAYLNAV VGTALIKKYP ALESEFVYGD

YKVYDVRKMI AKSEQEIGKA TAKYFFYSNI MNFFKTEITL ANGEIRKAPL IETNGETGEI

VWDKGRDFAT VRKVLSMPQV NIVKKTEVQT GGFSKESILP KRNSDKLIAR KKDWDPKKYG

GFDSPTVAYS VLVVAKVEKG KSKKLKSVKE LLGITIMERS SFEKNPIDFL EAKGYKEVKK

DLIIKLPKYS LFELENGRKR MLASAGELQK GNELALPSKY VNFLYLASHY EKLKGSPEDN

EQKQLFVEQH KHYLDEIIEQ ISEFSKRVIL ADANLDKVLS AYNKHRDKPI REQAENIIHL
```

```
FTLTNLGAPA AFKYFDTTID RKRYTSTKEV LDATLIHQSI TGLYETRIDL SQLGGDSRAD

PKKKRKVHHH HHH iProt106884 (SEQ ID NO: 7831):
MAPKKKRKVD KKYSIGLDIG TNSVGWAVIT DEYKVPSKKF KVLGNTDRHS IKKNLIGALL

FDSGETAEAT RLKRTARRRY TRRKNRICYL QEIFSNEMAK VDDSFFHRLE ESFLVEEDKK

HERHPIFGNI VDEVAYHEKY PTIYHLRKKL VDSTDKADLR LIYLALAHMI KFRGHFLIEG

DLNPDNSDVD KLFIQLVQTY NQLFEENPIN ASGVDAKAIL SARLSKSRRL ENLIAQLPGE

KKNGLFGNLI ALSLGLTPNF KSNFDLAEDA KLQLSKDTYD DDLDNLLAQI GDQYADLFLA

AKNLSDAILL SDILRVNTEI TKAPLSASMI KRYDEHHQDL TLLKALVRQQ LPEKYKEIFF

DQSKNGYAGY IDGGASQEEF YKFIKPILEK MDGTEELLVK LNREDLLRKQ RTFDNGSIPH

QIHLGELHAI LRRQEDFYPF LKDNREKIEK ILTFRIPYYV GPLARGNSRF AWMTRKSEET

ITPWNFEEVV DKGASAQSFI ERMTAFDKNL PNEKVLPKHS LLYEYFTVYN ELTKVKYVTE

GMRKPAFLSG EQKKAIVDLL FKTNRKVTVK QLKEDYFKKI ECFDSVEISG VEDRFNASLG

TYHDLLKIIK DKDFLDNEEN EDILEDIVLT LTLFEDREMI EERLKTYAHL FDDKVMKQLK

RRRYTGWGAL SRKLINGIRD KQSGKTILDF LKSDGFANRN FMALIHDDSL TFKEDIQKAQ

VSGQGDSLHE HIANLAGSPA IKKGILQTVK VVDELVKVMG RHKPENIVIE MARENQTTQK

GQKNSRERMK RIEEGIKELG SQILKEHPVE NTQLQNEKLY LYYLQNGRDM YVDQELDINR

LSDYDVDHIV PQSFLKDDSI DNKVLTRSDK NRGKSDNVPS EEVVKKMKNY WRQLLNAKLI

TQRKFDNLTK AERGGLSELD KAGFIKRQLV ETRAITKHVA QILDSRMNTK YDENDKLIRE

VKVITLKSKL VSDFRKDFQF YKVREINNYH HAHDAYLNAV VGTALIKKYP KLESEFVYGD

YKVYDVRKMI AKSEQEIGKA TAKYFFYSNI MNFFKTEITL ANGEIRKRPL IETNGETGEI

VWDKGRDFAT VRKVLSMPQV NIVKKTEVQT GGFSKESILP KRNSDKLIAR KKDWDPKKYG

GFDSPTVAYS VLVVAKVEKG KSKKLKSVKE LLGITIMERS SFEKNPIDFL EAKGYKEVKK

DLIIKLPKYS LFELENGRKR MLASAGELQK GNELALPSKY VNFLYLASHY EKLKGSPEDN

EQKQLFVEQH KHYLDEIIEQ ISEFSKRVIL ADANLDKVLS AYNKHRDKPI REQAENIIHL

FTLTNLGAPA AFKYFDTTID RKRYTSTKEV LDATLIHQSI TGLYETRIDL SQLGGDSRAD

PKKKRKVHHH HHH
```

Nucleic Acids Encoding Cas9 Molecules

Nucleic acids encoding the Cas9 molecules, e.g., an active Cas9 molecule or an inactive Cas9 molecule are provided herein.

Exemplary nucleic acids encoding Cas9 molecules are described in Cong et al, SCIENCE 2013, 399(6121):819-823; Wang et al, CELL 2013, 153(4):910-918; Mali et al., SCIENCE 2013, 399(6121):823-826; Jinek et al, SCIENCE 2012, 337(6096):816-821.

In an embodiment, a nucleic acid encoding a Cas9 molecule can be a synthetic nucleic acid sequence. For example, the synthetic nucleic acid molecule can be chemically modified, e.g., as described in Section XIII. In an embodiment, the Cas9 mRNA has one or more of, e.g., all of the following properties: it is capped, polyadenylated, substituted with 5-methylcytidine and/or pseudouridine.

In addition or alternatively, the synthetic nucleic acid sequence can be codon optimized, e.g., at least one non-common codon or less-common codon has been replaced by a common codon. For example, the synthetic nucleic acid can direct the synthesis of an optimized messenger mRNA, e.g., optimized for expression in a mammalian expression system, e.g., described herein.

Provided below is an exemplary codon optimized nucleic acid sequence encoding a Cas9 molecule of *S. pyogenes*.

```
                                                    (SEQ ID NO: 6628)
atggataaaa agtacagcat cgggctggac atcggtacaa actcagtggg gtgggccgtg     60
attacggacg agtacaaggt accctccaaa aaatttaaag tgctgggtaa cacggacaga    120
cactctataa agaaaaatct tattggagcc ttgctgttcg actcaggcga gacagccgaa    180
gccacaaggt tgaagcggac cgccaggagg cggtatacca ggagaaagaa ccgcatatgc    240
```

-continued

```
tacctgcaag aaatcttcag taacgagatg gcaaaggttg acgatagctt tttccatcgc    300
ctggaagaat cctttcttgt tgaggaagac aagaagcacg aacggcaccc catctttggc    360
aatattgtcg acgaagtggc atatcacgaa aagtacccga ctatctacca cctcaggaag    420
aagctggtgg actctaccga taaggcggac ctcagactta tttatttggc actcgcccac    480
atgattaaat ttagaggaca tttcttgatc gagggcgacc tgaacccgga caacagtgac    540
gtcgataagc tgttcatcca acttgtgcag acctacaatc aactgttcga agaaaaccct    600
ataaatgctt caggagtcga cgctaaagca atcctgtccg cgcgcctctc aaaatctaga    660
agacttgaga atctgattgc tcagttgccc ggggaaaaga aaatggatt gtttggcaac     720
ctgatcgccc tcagtctcgg actgaccca aatttcaaaa gtaacttcga cctggccgaa     780
gacgctaagc tccagctgtc caaggacaca tacgatgacg acctcgacaa tctgctggcc    840
cagattgggg atcagtacgc cgatctcttt ttggcagcaa agaacctgtc cgacgccatc    900
ctgttgagcg atatcttgag agtgaacacc gaaattacta aagcaccct tagcgcatct     960
atgatcaagc ggtacgacga gcatcatcag gatctgaccc tgctgaaggc tcttgtgagg   1020
caacagctcc ccgaaaaata caaggaaatc ttctttgacc agagcaaaaa cggctacgct   1080
ggctatatag atggtggggc cagtcaggag gaattctata aattcatcaa gcccattctc   1140
gagaaaatgg acggcacaga ggagttgctg gtcaaactta acaggaggga cctgctgcgg   1200
aagcagcgga cctttgacaa cgggtctatc ccccaccaga ttcatctggg cgaactgcac   1260
gcaatcctga ggaggcagga ggatttttat cctttctta aagataaccg cgagaaaata   1320
gaaaagattc ttacattcag gatcccgtac tacgtgggac ctctcgcccg gggcaattca   1380
cggtttgcct ggatgacaag gaagtcgag gagactatta caccttggaa cttcgaagaa    1440
gtggtggaca agggtgcatc tgcccagtct ttcatcgagc ggatgacaaa ttttgacaag   1500
aacctcccta tgagaaggt gctgcccaaa cattctctgc tctacgagta ctttaccgtc    1560
tacaatgaac tgactaaagt caagtacgtc accgagggaa tgaggaagcc ggcattcctt   1620
agtggagaac agaagaaggc gattgtagac ctgttgttca agaccaacag gaaggtgact   1680
gtgaagcaac ttaaagaaga ctactttaag aagatcgaat gttttgacag tgtggaaatt   1740
tcaggggttg aagaccgctt caatgcgtca ttggggactt accatgatct tctcaagatc   1800
ataaaggaca aagacttcct ggacaacgaa gaaaatgagg atattctcga agacatcgtc   1860
ctcaccctga ccctgttcga agacagggaa atgatagaag agcgcttgaa aacctatgcc   1920
cacctcttcg acgataaagt tatgaagcag ctgaagcgca ggagatacac aggatgggga   1980
agattgtcaa ggaagctgat caatggaatt agggataaac agagtggcaa gaccatactg   2040
gatttcctca aatctgatgg cttcgccaat aggaacttca tgcaactgat tcacgatgac   2100
tctcttacct tcaaggagga cattcaaaag gctcaggtga gcgggcaggg agactccctt   2160
catgaacaca tcgcgaattt ggcaggttcc cccgctatta aaaagggcat ccttcaaact   2220
gtcaaggtgg tggatgaatt ggtcaaggta atgggcagac ataagccaga aaatattgtg   2280
atcgagatgg cccgcgaaaa ccagaccaca cagaagggcc agaaaaatag tagagagcgg   2340
atgaagagga tcgaggaggg catcaaagag ctgggatctc agattctcaa agaacacccc   2400
gtagaaaaca cacagctgca gaacgaaaaa ttgtacttgt actatctgca gaacggcaga   2460
gacatgtacg tcgaccaaga acttgatatt aatagactgt ccgactatga cgtagaccat   2520
atcgtgcccc agtccttcct gaaggacgac tccattgata caaagtctt gacaagaagc   2580
gacaagaaca ggggtaaaag tgataatgtg cctagcgagg aggtggtgaa aaaaatgaag   2640
```

```
                                   -continued
aactactggc gacagctgct taatgcaaag ctcattacac aacggaagtt cgataatctg  2700
acgaaagcag agagaggtgg cttgtctgag ttggacaagg cagggtttat taagcggcag  2760
ctggtggaaa ctaggcagat cacaaagcac gtggcgcaga ttttggacag ccggatgaac  2820
acaaaatacg acgaaaatga taaactgata cgagaggtca aagttatcac gctgaaaagc  2880
aagctggtgt ccgattttcg gaaagacttc cagttctaca aagttcgcga gattaataac  2940
taccatcatg ctcacgatgc gtacctgaac gctgttgtcg ggaccgcctt gataaagaag  3000
tacccaaagc tggaatccga gttcgtatac ggggattaca aagtgtacga tgtgaggaaa  3060
atgatagcca agtccgagca ggagattgga aaggccacag ctaagtactt cttttattct  3120
aacatcatga attttttttaa gacggaaatt accctggcca acggagagat cagaaagcgg  3180 cccttatag agacaaatgg tgaaacaggt gaaatcgtct gggataaggg cagggatttc   3240
gctactgtga ggaaggtgct gagtatgcca caggtaaata tcgtgaaaaa aaccgaagta  3300
cagaccggag gattttccaa ggaaagcatt ttgcctaaaa gaaactcaga caagctcatc  3360
gcccgcaaga aagattggga ccctaagaaa tacggggat ttgactcacc caccgtagcc   3420
tattctgtgc tggtggtagc taaggtggaa aaaggaaagt ctaagaagct gaagtccgtg  3480
aaggaactct tgggaatcac tatcatgaaa agatcatcct ttgaaaagaa ccctatcgat  3540
ttcctggagg ctaagggtta caaggaggtc aagaaagacc tcatcattaa actgccaaaa  3600
tactctctct tcgagctgga aaatggcagg aagagaatgt tggccagcgc cggagagctg  3660
caaaagggaa acgagcttgc tctgccctcc aaatatgtta attttctcta tctcgcttcc  3720
cactatgaaa agctgaaagg gtctcccgaa gataacgagc agaagcagct gttcgtcgaa  3780
cagcacaagc actatctgga tgaaataatc gaacaaataa gcgagttcag caaaagggtt  3840
atcctggcgg atgctaattt ggacaaagta ctgtctgctt ataacaagca ccgggataag  3900
cctattaggg aacaagccga gaatataatt caccctcttta cactcacgaa tctcggagcc  3960
cccgccgcct tcaaatactt tgatacgact atcgaccgga aacggtatac cagtaccaaa  4020
gaggtcctcg atgccaccct catccaccag tcaattactg gcctgtacga aacacggatc  4080
gacctctctc aactgggcgg cgactag                                       4107
```

If the above Cas9 sequences are fused with a peptide or polypeptide at the C-terminus (e.g., an inactive Cas9 fused with a transcription repressor at the C-terminus), it is understood that the stop codon will be removed.

V. Chimeric Antigen Receptors

The invention provides for gRNA molecules and CRISPR systems for use in connection with adoptive immunotherapy methods and reagents such as chimeric antigen receptor (CAR) immune effector cells, e.g., T cells, or chimeric TCR-transduced immune effector cells, e.g., T cells. The gRNA molecules and CRISPR systems of the invention can be used to create adoptive immunotherapy cells and compositions with improved properties, such as efficacy and safety. This section describes CAR technology generally that is useful in conjunction with the gRNA molecules and CRISPR systems of the invention, and describes improved CAR reagents, e.g., cells and compositions, and methods.

In general, aspects of the invention pertain to or include an isolated nucleic acid molecule encoding a chimeric antigen receptor (CAR), wherein the CAR comprises an antigen binding domain (e.g., antibody or antibody fragment, TCR or TCR fragment) that binds to a tumor antigen as described herein, a transmembrane domain (e.g., a transmembrane domain described herein), and an intracellular signaling domain (e.g., an intracellular signaling domain described herein) (e.g., an intracellular signaling domain comprising a costimulatory domain (e.g., a costimulatory domain described herein) and/or a primary signaling domain (e.g., a primary signaling domain described herein). In other aspects, the invention includes: host cells containing the above nucleic acids and isolated proteins encoded by such nucleic acid molecules. CAR nucleic acid constructs, encoded proteins, containing vectors, host cells, pharmaceutical compositions, and methods of administration and treatment related to the present invention are disclosed in detail in International Patent Application Publication No. WO2015142675, which is incorporated by reference in its entirety.

In one aspect, the invention pertains to an isolated nucleic acid molecule encoding a chimeric antigen receptor (CAR), wherein the CAR comprises an antigen binding domain (e.g., antibody or antibody fragment, TCR or TCR fragment) that binds to a tumor-supporting antigen (e.g., a tumor-supporting antigen as described herein), a transmembrane domain (e.g., a transmembrane domain described herein), and an intracellular signaling domain (e.g., an intracellular signaling domain described herein) (e.g., an intracellular signaling domain comprising a costimulatory domain (e.g., a costimulatory domain described herein) and/or a primary signaling domain (e.g., a primary signaling domain described herein). In some embodiments, the tumor-supporting antigen is an antigen present on a stromal cell or a myeloid-derived suppressor cell (MDSC). In other aspects, the invention features polypeptides encoded by such nucleic acids and host cells containing such nucleic acids and/or polypeptides.

Alternatively, aspects of the invention pertain to isolated nucleic acid encoding a chimeric T cell receptor (TCR) comprising a TCR alpha and/or TCR beta variable domain with specificity for a cancer antigen described herein. See for example, Dembic et al., Nature, 320, 232-238 (1986), Schumacher, Nat. Rev. Immunol., 2, 512-519 (2002), Kershaw et al., Nat. Rev. Immunol., 5, 928-940 (2005), Xue et al., Clin. Exp. Immunol., 139, 167-172 (2005), Rossig et al., Mol. Ther., 10, 5-18 (2004), and Murphy et al., Immunity, 22, 403-414 (2005); (Morgan et al. J. Immunol., 171, 3287-3295 (2003), Hughes et al., Hum. Gene Ther., 16, 1-16 (2005), Zhao et al., J. Immunol., 174, 4415-4423 (2005), Roszkowski et al., Cancer Res., 65, 1570-1576 (2005), and Engels et al., Hum. Gene Ther., 16, 799-810 (2005); US2009/03046557, the contents of which are hereby incorporated by reference in their entirety. Such chimeric TCRs may recognize, for example, cancer antigens such as MART-1, gp-100, p53, and NY-ESO-1, MAGE A3/A6, MAGEA3, SSX2, HPV-16 E6 or HPV-16 E7. In other aspects, the invention features polypeptides encoded by such nucleic acids and host cells containing such nucleic acids and/or polypeptides.

Targets

The present invention provides cells, e.g., immune effector cells (e.g., T cells, NK cells), that comprise or at any time comprised a gRNA molecule or CRISPR system as described herein, that are further engineered to contain one or more CARs that direct the immune effector cells to undesired cells (e.g., cancer cells). This is achieved through an antigen binding domain on the CAR that is specific for a cancer associated antigen. There are two classes of cancer associated antigens (tumor antigens) that can be targeted by the CARs of the instant invention: (1) cancer associated antigens that are expressed on the surface of cancer cells; and (2) cancer associated antigens that itself is intracelluar, however, a fragment of such antigen (peptide) is presented on the surface of the cancer cells by MHC (major histocompatibility complex).

In some embodiments, the tumor antigen is chosen from one or more of: CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRvIII); ganglioside G2 (GD2); ganglioside GD3 (aNeu5Ac(2-8)aNeu5Ac(2-3)bDGalp(1-4)bDGlcp(1-1) Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDGalp(1-4) bDGlcp(1-1)Cer); transglutaminase 5 (TGS5); high molecular weight-melanoma-associated antigen (HMW-MAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1);

Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1).

A CAR described herein can comprise an antigen binding domain (e.g., antibody or antibody fragment, TCR or TCR fragment) that binds to a tumor-supporting antigen (e.g., a tumor-supporting antigen as described herein). In some embodiments, the tumor-supporting antigen is an antigen present on a stromal cell or a myeloid-derived suppressor cell (MDSC). Stromal cells can secrete growth factors to promote cell division in the microenvironment. MDSC cells can inhibit T cell proliferation and activation. Without wishing to be bound by theory, in some embodiments, the CAR-expressing cells destroy the tumor-supporting cells, thereby indirectly inhibiting tumor growth or survival.

In embodiments, the stromal cell antigen is chosen from one or more of: bone marrow stromal cell antigen 2 (BST2), fibroblast activation protein (FAP) and tenascin. In an embodiment, the FAP-specific antibody is, competes for binding with, or has the same CDRs as, sibrotuzumab. In embodiments, the MDSC antigen is chosen from one or more of: CD33, CD11b, C14, CD15, and CD66b. Accordingly, in some embodiments, the tumor-supporting antigen is chosen from one or more of: bone marrow stromal cell antigen 2 (BST2), fibroblast activation protein (FAP) or tenascin, CD33, CD11b, C14, CD15, and CD66b.

Antigen Binding Domain Structures

In some embodiments, the antigen binding domain of the encoded CAR molecule comprises an antibody, an antibody fragment, an scFv, a Fv, a Fab, a (Fab')2, a single domain antibody (SDAB), a VH or VL domain, a camelid VHH domain or a bi-functional (e.g. bi-specific) hybrid antibody (e.g., Lanzavecchia et al., Eur. J. Immunol. 17, 105 (1987)).

In some instances, scFvs can be prepared according to method known in the art (see, for example, Bird et al., (1988) Science 242:423-426 and Huston et al., (1988) Proc. Natl. Acad. Sci. USA 85:5879-5883). ScFv molecules can be produced by linking VH and VL regions together using flexible polypeptide linkers. The scFv molecules comprise a linker (e.g., a Ser-Gly linker) with an optimized length and/or amino acid composition. The linker length can greatly affect how the variable regions of a scFv fold and interact. In fact, if a short polypeptide linker is employed (e.g., between 5-10 amino acids) intrachain folding is prevented. Interchain folding is also required to bring the two variable regions together to form a functional epitope binding site. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, is incorporated herein by reference.

An scFv can comprise a linker of at least 1, 2, 3, 4, 5, 6, 7, 8, 9, 10, 11, 12, 13, 14, 15, 16, 17, 18, 19, 20, 25, 30, 35, 40, 45, 50, or more amino acid residues between its VL and VH regions. The linker sequence may comprise any naturally occurring amino acid. In some embodiments, the linker sequence comprises amino acids glycine and serine. In another embodiment, the linker sequence comprises sets of glycine and serine repeats such as (Gly$_4$Ser)n, where n is a positive integer equal to or greater than 1 (SEQ ID NO:6629). In one embodiment, the linker can be (Gly4Ser)$_4$ (SEQ ID NO:6593) or (Gly$_4$Ser) 3 (SEQ ID NO:6594). Variation in the linker length may retain or enhance activity, giving rise to superior efficacy in activity studies.

In another aspect, the antigen binding domain is a T cell receptor ("TCR"), or a fragment thereof, for example, a single chain TCR (scTCR). Methods to make such TCRs are known in the art. See, e.g., Willemsen R A et al, Gene Therapy 7: 1369-1377 (2000); Zhang T et al, Cancer Gene Ther 11: 487-496 (2004); Aggen et al, Gene Ther. 19(4): 365-74 (2012) (references are incorporated herein by its entirety). For example, scTCR can be engineered that contains the Vα and Vβ genes from a T cell clone linked by a linker (e.g., a flexible peptide). This approach is very useful to cancer associated target that itself is intracelluar, however, a fragment of such antigen (peptide) is presented on the surface of the cancer cells by MHC.

In certain embodiments, the encoded antigen binding domain has a binding affinity KD of $10^{-4}$ M to $10^{-8}$ M.

In one embodiment, the encoded CAR molecule comprises an antigen binding domain that has a binding affinity KD of $10^{-4}$ M to $10^{-8}$ M, e.g., $10^{-5}$ M to $10^{-7}$ M, e.g., $10^{-6}$ M or $10^{-7}$ M, for the target antigen. In one embodiment, the antigen binding domain has a binding affinity that is at least five-fold, 10-fold, 20-fold, 30-fold, 50-fold, 100-fold or 1,000-fold less than a reference antibody, e.g., an antibody described herein. In one embodiment, the encoded antigen binding domain has a binding affinity at least 5-fold less than a reference antibody (e.g., an antibody from which the antigen binding domain is derived). In one aspect such antibody fragments are functional in that they provide a biological response that can include, but is not limited to, activation of an immune response, inhibition of signal-transduction origination from its target antigen, inhibition of kinase activity, and the like, as will be understood by a skilled artisan.

In one aspect, the antigen binding domain of the CAR is a scFv antibody fragment that is humanized compared to the murine sequence of the scFv from which it is derived.

In one aspect, the antigen binding domain of a CAR of the invention (e.g., a scFv) is encoded by a nucleic acid molecule whose sequence has been codon optimized for expression in a mammalian cell. In one aspect, entire CAR construct of the invention is encoded by a nucleic acid molecule whose entire sequence has been codon optimized for expression in a mammalian cell. Codon optimization refers to the discovery that the frequency of occurrence of synonymous codons (i.e., codons that code for the same amino acid) in coding DNA is biased in different species. Such codon degeneracy allows an identical polypeptide to be encoded by a variety of nucleotide sequences. A variety of codon optimization methods is known in the art, and include, e.g., methods disclosed in at least U.S. Pat. Nos. 5,786,464 and 6,114,148.

Antigen Binding Domains (and the Targeted Antigens)

In one embodiment, an antigen binding domain against CD19 is an antigen binding portion, e.g., CDRs, of a CAR, antibody or antigen-binding fragment thereof described in, e.g., PCT publication WO2012/079000; PCT publication WO2014/153270; Kochenderfer, J. N. et al., J. Immunother. 32 (7), 689-702 (2009); Kochenderfer, J. N., et al., Blood, 116 (20), 4099-4102 (2010); PCT publication WO2014/031687; Bejcek, Cancer Research, 55, 2346-2351, 1995; or U.S. Pat. No. 7,446,190.

In one embodiment, an antigen binding domain against mesothelin is an antigen binding portion, e.g., CDRs, of an antibody, antigen-binding fragment or CAR described in, e.g., PCT publication WO2015/090230. In one embodiment, an antigen binding domain against mesothelin is an antigen binding portion, e.g., CDRs, of an antibody, antigen-binding fragment, or CAR described in, e.g., PCT publication WO1997/025068, WO1999/028471, WO2005/014652, WO2006/099141, WO2009/045957, WO2009/068204, WO2013/142034, WO2013/040557, or WO2013/063419. In one embodiment, an antigen binding domain against mesothelin is an antigen binding portion, e.g., CDRs, of an antibody, antigen-binding fragment, or CAR described in WO/2015/090230.

In one embodiment, an antigen binding domain against CD123 is an antigen binding portion, e.g., CDRs, of an antibody, antigen-binding fragment or CAR described in, e.g., PCT publication WO2014/130635. In one embodiment, an antigen binding domain against CD123 is an antigen binding portion, e.g., CDRs, of an antibody, antigen-binding fragment, or CAR described in, e.g., PCT publication WO2014/138805, WO2014/138819, WO2013/173820, WO2014/144622, WO2001/66139, WO2010/126066, WO2014/144622, or US2009/0252742. In one embodiment, an antigen binding domain against CD123 is an antigen binding portion, e.g., CDRs, of an antibody, antigen-binding fragment, or CAR described in WO/2016/028896.

Examples include CAR molecules which include an antigen binding domain, or a VL and VH (in the sequences below, separated by a (G4S)3 linker (SEQ ID NO: 6594)) of:

CD123-1:
(SEQ ID NO: 7812)
QVQLVQSGAEVKKPGASVKVSCKASGYTFTGYYMHWVRQAPGQGLEWMG

WINPNSGGTNYAQKFQGRVTMTRDTSISTAYMELSRLRSDDTAVYYCAR

DMNILATVPFDIWGQGTMVTVSSGGGGSGGGGSGGGGSDIQMTQSPSSL

SASVGDRVTITCRASQSISTYLNWYQQKPGKAPNLLIYAAFSLQSGVPS

RFSGSGSGTDFTLTINSLQPEDFATYYCQQGDSVPLTFGGGTKLEIK;

CD123-2:
(SEQ ID NO: 7813)
QVQLVQSGAEVKKPGASVKVSCKASGYTFTGYYMHWVRQAPGQGLEWMG

WINPNSGGTNYAQKFQGRVTLTRDTSISTVYMELSRLRSDDTAVYYCAR

DMNILATVPFDIWGQGTMVTVSSGGGGSGGGGSGGGGSDIQMTQSPSSL

SASVGDRVTITCRASQSISSYLNWYQQKPGKAPKLLIYAASSLQSGVPS

RFSGSGSGTDFTLTVNSLQPEDFATYYCQQGDSVPLTFGGGTRLEIK;

CD123-3:
(SEQ ID NO: 7814)
QVQLVQSGAEVKKPGASVKVSCKASGYIFTGYYIHWVRQAPGQGLEWMG

WINPNSGGTNYAQKFQGRVTMTRDTSISTAYMELSGLRSDDPAVYYCAR

DMNILATVPFDIWGQGTLVTVSSGGGGSGGGGSGGGGSDIQLTQSPSSL

SASVGDRVTITCRASQSISSYLNWYQQKPGKAPKLLIYAASSLQSGVPS

RFSGSGSGTDFTLTVNSLQPEDFATYYCQQGDSVPLTFGGGTKVEIK;
OR

CD123-4:
(SEQ ID NO: 7815)
QVQLQQSGAEVKKSGASVKVSCKASGYTFTDYYMHWLRQAPGQGLEWMG

WINPNSGDTNYAQKFQGRVTLTRDTSISTVYMELSRLRSDDTAVYYCAR

DMNILATVPFDIWGQGTMVTVSSASGGGGSGGRASGGGGSDIQMTQSPS

SLSASVGDRVTITCRASQSISSYLNWYQQKPGKAPKLLIYAASSLQSGV

PSRFSGSGSGTDFTLTISSLQPEDFATYYCQQGDSVPLTFGGGTKVEIK,
from WO2016/0028896.

The CAR comprising said anti-CD123 binding domain may comprise, for example, the amino acid sequence of:

CAR123-2:
(SEQ ID NO: 7816)
MALPVTALLLPLALLLHAARPQVQLVQSGAEVKKPGASVKVSCKASGYTF

TGYYMHWVRQAPGQGLEWMGWINPNSGGTNYAQKFQGRVTLTRDTSISTV

YMELSRLRSDDTAVYYCARDMNILATVPFDIWGQGTMVTVSSGGGGSGGG

GSGGGGSDIQMTQSPSSLSASVGDRVTITCRASQSISSYLNWYQQKPGKA

PKLLIYAASSLQSGVPSRFSGSGSGTDFTLTVNSLQPEDFATYYCQQGDS

VPLTFGGGTRLEIKTTTPAPRPPTPAPTIASQPLSLRPEACRPAAGGAVH

TRGLDFACDIYIWAPLAGTCGVLLLSLVITLYCKRGRKKLLYIFKQPFMR

PVQTTQEEDGCSCRFPEEEEGGCELRVKFSRSADAPAYKQGQNQLYNELN

LGRREEYDVLDKRRGRDPEMGGKPRRKNPQEGLYNELQKDKMAEAYSEIG

MKGERRRGKGHDGLYQGLSTATKDTYDALHMQALPPR;

CAR123-3:
(SEQ ID NO: 7817)
MALPVTALLLPLALLLHAARPQVQLVQSGAEVKKPGASVKVSCKASGYIF

TGYYIHWVRQAPGQGLEWMGWINPNSGGTNYAQKFQGRVTMTRDTSISTA

YMELSGLRSDDPAVYYCARDMNILATVPFDIWGQGTLVTVSSGGGGSGGG

GSGGGGSDIQLTQSPSSLSASVGDRVTITCRASQSISSYLNWYQQKPGKA

PKLLIYAASSLQSGVPSRFSGSGSGTDFTLTVNSLQPEDFATYYCQQGDS

VPLTFGGGTKVEIKTTTPAPRPPTPAPTIASQPLSLRPEACRPAAGGAVH

TRGLDFACDIYIWAPLAGTCGVLLLSLVITLYCKRGRKKLLYIFKQPFMR

PVQTTQEEDGCSCRFPEEEEGGCELRVKFSRSADAPAYKQGQNQLYNELN

LGRREEYDVLDKRRGRDPEMGGKPRRKNPQEGLYNELQKDKMAEAYSEIG

MKGERRRGKGHDGLYQGLSTATKDTYDALHMQALPPR;

CAR123-4:
(SEQ ID NO: 7818)
MALPVTALLLPLALLLHAARPQVQLQQSGAEVKKSGASVKVSCKASGYTF

TDYYMHWLRQAPGQGLEWMGWINPNSGDTNYAQKFQGRVTLTRDTSISTV

YMELSRLRSDDTAVYYCARDMNILATVPFDIWGQGTMVTVSSASGGGGSG

GRASGGGGSDIQMTQSPSSLSASVGDRVTITCRASQSISSYLNWYQQKPG

KAPKLLIYAASSLQSGVPSRFSGSGSGTDFTLTISSLQPEDFATYYCQQG

DSVPLTFGGGTKVEIKTTTPAPRPPTPAPTIASQPLSLRPEACRPAAGGA

VHTRGLDFACDIYIWAPLAGTCGVLLLSLVITLYCK;
OR

CAR123-1:
(SEQ ID NO: 7819)
malpvtalllplalllhaarpqvqlvqsgaevkkpgasvkvsckasgytf tgyymhwvrqapgqglewmgwinpnsggtnyaqkfqgrvtmtrdtsista ymelsrlrsddtavyycardmnilatvpfdiwgqgtmvtvssggggsggg -continued

```
gsggggsdiqmtqspsslsasvgdrvtitcrasqsistylnwyqqkpgka pnlliyaafslqsgvpsrfsgsgsgtdftltinslqpedfatyycqqgds vpltfgggtkleiktttpaprpptpaptiasqplslrpeacrpaaggavh trgldfacdiyiwaplagtcgvlllslvitlyckrgrkkllyifkqpfmr pvqttqeedgcscrfpeeeeggcelrvkfsrsadapaykqgqnqlyneln lgrreeydvldkrrgrdpemggkprrknpqeglynelqkdkmaeayseig mkgerrrgkghdglyqglstatkdtydalhmqalppr.
In each case, the CAR may optionally comprise or
not comprise the leader sequence included in each
of the above sequences (MALPVTALLLPLALLLHAARP;
SEQ ID NO: 6640).
```

In one embodiment, an antigen binding domain against EGFRvIII is an antigen binding portion, e.g., CDRs, of an antibody, antigen-binding fragment or CAR described in, e.g., WO/2014/130657.

In one embodiment, an antigen binding domain against CD22 is an antigen binding portion, e.g., CDRs, of an antibody described in, e.g., Haso et al., Blood, 121(7): 1165-1174 (2013); Wayne et al., Clin Cancer Res 16(6): 1894-1903 (2010); Kato et al., Leuk Res 37(1):83-88 (2013); Creative BioMart (creativebiomart.net): MOM-18047-S(P).

In one embodiment, an antigen binding domain against CS-1 is an antigen binding portion, e.g., CDRs, of Elotuzumab (BMS), see e.g., Tai et al., 2008, Blood 112(4): 1329-37; Tai et al., 2007, Blood. 110(5):1656-63.

In one embodiment, an antigen binding domain against CLL-1 is an antigen binding portion, e.g., CDRs, of an antibody available from R&D, ebiosciences, Abcam, for example, PE-CLL1-hu Cat #353604 (BioLegend); and PE-CLL1 (CLEC12A) Cat #562566 (BD). In one embodiment, an antigen binding domain against CLL-1 is an antigen binding portion, e.g., CDRs, of an antibody, antigen-binding fragment, or CAR described in WO/2016/014535.

In one embodiment, an antigen binding domain against CD33 is an antigen binding portion, e.g., CDRs, of an antibody described in, e.g., Bross et al., Clin Cancer Res 7(6):1490-1496 (2001) (Gemtuzumab Ozogamicin, hP67.6), Caron et al., Cancer Res 52(24):6761-6767 (1992) (Lintuzumab, HuM195), Lapusan et al., Invest New Drugs 30(3):1121-1131 (2012) (AVE9633), Aigner et al., Leukemia 27(5): 1107-1115 (2013) (AMG330, CD33 BiTE), Dutour et al., Adv hematol 2012:683065 (2012), and Pizzitola et al., Leukemia doi:10.1038/Lue.2014.62 (2014). In one embodiment, an antigen binding domain against CD33 is an antigen binding portion, e.g., CDRs, of an antibody, antigen-binding fragment, or CAR described in WO/2016/014576.

In one embodiment, an antigen binding domain against GD2 is an antigen binding portion, e.g., CDRs, of an antibody described in, e.g., Mujoo et al., Cancer Res. 47(4):1098-1104 (1987); Cheung et al., Cancer Res 45(6): 2642-2649 (1985), Cheung et al., J Clin Oncol 5(9):1430-1440 (1987), Cheung et al., J Clin Oncol 16(9):3053-3060 (1998), Handgretinger et al., Cancer Immunol Immunother 35(3):199-204 (1992). In some embodiments, an antigen binding domain against GD2 is an antigen binding portion of an antibody selected from mAb 14.18, 14G2a, ch14.18, hu14.18, 3F8, hu3F8, 3G6, 8B6, 60C3, 10B8, ME36.1, and 8H9, see e.g., WO2012033885, WO2013040371, WO2013192294, WO2013061273, WO2013123061, WO2013074916, and WO201385552. In some embodiments, an antigen binding domain against GD2 is an antigen binding portion of an antibody described in US Publication No.: 20100150910 or PCT Publication No.: WO 2011160119.

In one embodiment, an antigen binding domain against BCMA is an antigen binding portion, e.g., CDRs, of an antibody described in, e.g., WO2012163805, WO200112812, and WO2003062401. In one embodiment, an antigen binding domain against BCMA is an antigen binding portion, e.g., CDRs, of an antibody, antigen-binding fragment, or CAR described in WO/2016/014565.

In one embodiment, an antigen binding domain against Tn antigen is an antigen binding portion, e.g., CDRs, of an antibody described in, e.g., U.S. Pat. No. 8,440,798, Brooks et al., PNAS 107(22):10056-10061 (2010), and Stone et al., OncoImmunology 1(6):863-873(2012).

In one embodiment, an antigen binding domain against PSMA is an antigen binding portion, e.g., CDRs, of an antibody described in, e.g., Parker et al., Protein Expr Purif 89(2):136-145 (2013), US 20110268656 (J591 ScFv); Frigerio et al, European J Cancer 49(9):2223-2232 (2013) (scFvD2B); WO 2006125481 (mAbs 3/A12, 3/E7 and 3/F11) and single chain antibody fragments (scFv A5 and D7).

In one embodiment, an antigen binding domain against ROR1 is an antigen binding portion, e.g., CDRs, of an antibody described in, e.g., Hudecek et al., Clin Cancer Res 19(12):3153-3164 (2013); WO 2011159847; and US20130101607.

In one embodiment, an antigen binding domain against FLT3 is an antigen binding portion, e.g., CDRs, of an antibody described in, e.g., WO2011076922, U.S. Pat. No. 5,777,084, EP0754230, US20090297529, and several commercial catalog antibodies (R&D, ebiosciences, Abcam).

In one embodiment, an antigen binding domain against TAG72 is an antigen binding portion, e.g., CDRs, of an antibody described in, e.g., Hombach et al., Gastroenterology 113(4):1163-1170 (1997); and Abcam ab691.

In one embodiment, an antigen binding domain against FAP is an antigen binding portion, e.g., CDRs, of an antibody described in, e.g., Ostermann et al., Clinical Cancer Research 14:4584-4592 (2008) (FAP5), US Pat. Publication No. 2009/0304718; sibrotuzumab (see e.g., Hofheinz et al., Oncology Research and Treatment 26(1), 2003); and Tran et al., J Exp Med 210(6):1125-1135 (2013).

In one embodiment, an antigen binding domain against CD38 is an antigen binding portion, e.g., CDRs, of daratumumab (see, e.g., Groen et al., Blood 116(21):1261-1262 (2010); MOR202 (see, e.g., U.S. Pat. No. 8,263,746); or antibodies described in U.S. Pat. No. 8,362,211.

In one embodiment, an antigen binding domain against CD44v6 is an antigen binding portion, e.g., CDRs, of an antibody described in, e.g., Casucci et al., Blood 122(20): 3461-3472 (2013).

In one embodiment, an antigen binding domain against CEA is an antigen binding portion, e.g., CDRs, of an antibody described in, e.g., Chmielewski et al., Gastoenterology 143(4):1095-1107 (2012).

In one embodiment, an antigen binding domain against EPCAM is an antigen binding portion, e.g., CDRS, of an antibody selected from MT110, EpCAM-CD3 bispecific Ab (see, e.g., clinicaltrials.gov/ct2/show/NCT00635596); Edrecolomab; 3622W94; ING-1; and adecatumumab (MT201).

In one embodiment, an antigen binding domain against PRSS21 is an antigen binding portion, e.g., CDRs, of an antibody described in U.S. Pat. No. 8,080,650.

In one embodiment, an antigen binding domain against B7H3 is an antigen binding portion, e.g., CDRs, of an antibody MGA271 (Macrogenics).

In one embodiment, an antigen binding domain against KIT is an antigen binding portion, e.g., CDRs, of an antibody described in, e.g., U.S. Pat. No. 7,915,391, US20120288506, and several commercial catalog antibodies.

In one embodiment, an antigen binding domain against IL-13Ra2 is an antigen binding portion, e.g., CDRs, of an antibody described in, e.g., WO2008/146911, WO2004087758, several commercial catalog antibodies, and WO2004087758.

In one embodiment, an antigen binding domain against CD30 is an antigen binding portion, e.g., CDRs, of an antibody described in, e.g., U.S. Pat. No. 7,090,843 B1, and EP0805871.

In one embodiment, an antigen binding domain against GD3 is an antigen binding portion, e.g., CDRs, of an antibody described in, e.g., U.S. Pat. Nos. 7,253,263; 8,207,308; US 20120276046; EP1013761; WO2005035577; and U.S. Pat. No. 6,437,098.

In one embodiment, an antigen binding domain against CD171 is an antigen binding portion, e.g., CDRs, of an antibody described in, e.g., Hong et al., J Immunother 37(2):93-104 (2014).

In one embodiment, an antigen binding domain against IL-11Ra is an antigen binding portion, e.g., CDRs, of an antibody available from Abcam (cat #ab55262) or Novus Biologicals (cat #EPR5446). In another embodiment, an antigen binding domain again IL-11Ra is a peptide, see, e.g., Huang et al., *Cancer Res* 72(1):271-281 (2012).

In one embodiment, an antigen binding domain against PSCA is an antigen binding portion, e.g., CDRs, of an antibody described in, e.g., Morgenroth et al., Prostate 67(10):1121-1131 (2007) (scFv 7F5); Nejatollahi et al., J of Oncology 2013(2013), article ID 839831 (scFv C5-II); and US Pat Publication No. 20090311181.

In one embodiment, an antigen binding domain against VEGFR2 is an antigen binding portion, e.g., CDRs, of an antibody described in, e.g., Chinnasamy et al., J Clin Invest 120(11):3953-3968 (2010).

In one embodiment, an antigen binding domain against LewisY is an antigen binding portion, e.g., CDRs, of an antibody described in, e.g., Kelly et al., Cancer Biother Radiopharm 23(4):411-423 (2008) (hu3S193 Ab (scFvs)); Dolezal et al., Protein Engineering 16(1):47-56 (2003) (NC 10 scFv).

In one embodiment, an antigen binding domain against CD24 is an antigen binding portion, e.g., CDRs, of an antibody described in, e.g., Maliar et al., Gastroenterology 143(5):1375-1384 (2012).

In one embodiment, an antigen binding domain against PDGFR-beta is an antigen binding portion, e.g., CDRs, of an antibody Abcam ab32570.

In one embodiment, an antigen binding domain against SSEA-4 is an antigen binding portion, e.g., CDRs, of antibody MC813 (Cell Signaling), or other commercially available antibodies.

In one embodiment, an antigen binding domain against CD20 is an antigen binding portion, e.g., CDRs, of the antibody Rituximab, Ofatumumab, Ocrelizumab, Veltuzumab, or GA101.

In one embodiment, an antigen binding domain against Folate receptor alpha is an antigen binding portion, e.g., CDRs, of the antibody IMGN853, or an antibody described in US20120009181; U.S. Pat. No. 4,851,332, LK26: U.S. Pat. No. 5,952,484.

In one embodiment, an antigen binding domain against ERBB2 (Her2/neu) is an antigen binding portion, e.g., CDRs, of the antibody trastuzumab, or pertuzumab.

In one embodiment, an antigen binding domain against MUC1 is an antigen binding portion, e.g., CDRs, of the antibody SAR566658.

In one embodiment, the antigen binding domain against EGFR is antigen binding portion, e.g., CDRs, of the antibody cetuximab, panitumumab, zalutumumab, nimotuzumab, or matuzumab.

In one embodiment, an antigen binding domain against NCAM is an antigen binding portion, e.g., CDRs, of the antibody clone 2-2B: MAB5324 (EMD Millipore).

In one embodiment, an antigen binding domain against Ephrin B2 is an antigen binding portion, e.g., CDRs, of an antibody described in, e.g., Abengozar et al., Blood 119(19): 4565-4576 (2012).

In one embodiment, an antigen binding domain against IGF-I receptor is an antigen binding portion, e.g., CDRs, of an antibody described in, e.g., U.S. Pat. No. 8,344,112 B2; EP2322550 A1; WO 2006/138315, or PCT/US2006/022995.

In one embodiment, an antigen binding domain against CAIX is an antigen binding portion, e.g., CDRs, of the antibody clone 303123 (R&D Systems).

In one embodiment, an antigen binding domain against LMP2 is an antigen binding portion, e.g., CDRs, of an antibody described in, e.g., U.S. Pat. No. 7,410,640, or US20050129701.

In one embodiment, an antigen binding domain against gp100 is an antigen binding portion, e.g., CDRs, of the antibody HMB45, NKIbetaB, or an antibody described in WO2013165940, or US20130295007

In one embodiment, an antigen binding domain against tyrosinase is an antigen binding portion, e.g., CDRs, of an antibody described in, e.g., U.S. Pat. No. 5,843,674; or U.S.19950504048.

In one embodiment, an antigen binding domain against EphA2 is an antigen binding portion, e.g., CDRs, of an antibody described in, e.g., Yu et al., Mol Ther 22(1):102-111 (2014).

In one embodiment, an antigen binding domain against GD3 is an antigen binding portion, e.g., CDRs, of an antibody described in, e.g., U.S. Pat. Nos. 7,253,263; 8,207,308; US 20120276046; EP1013761 A3; 20120276046; WO2005035577; or U.S. Pat. No. 6,437,098.

In one embodiment, an antigen binding domain against fucosyl GM1 is an antigen binding portion, e.g., CDRs, of an antibody described in, e.g., US20100297138; or WO2007/067992.

In one embodiment, an antigen binding domain against sLe is an antigen binding portion, e.g., CDRs, of the antibody G193 (for lewis Y), see Scott A M et al, Cancer Res 60: 3254-61 (2000), also as described in Neeson et al, J Immunol May 2013 190 (Meeting Abstract Supplement) 177.10.

In one embodiment, an antigen binding domain against GM3 is an antigen binding portion, e.g., CDRs, of the antibody CA 2523449 (mAb 14F7).

In one embodiment, an antigen binding domain against HMWMAA is an antigen binding portion, e.g., CDRs, of an antibody described in, e.g., Kmiecik et al., Oncoimmunology 3(1):e27185 (2014) (PMID: 24575382) (mAb9.2.27); U.S. Pat. No. 6,528,481; WO2010033866; or US 20140004124.

In one embodiment, an antigen binding domain against o-acetyl-GD2 is an antigen binding portion, e.g., CDRs, of the antibody 8B6.

In one embodiment, an antigen binding domain against TEM1/CD248 is an antigen binding portion, e.g., CDRs, of an antibody described in, e.g., Marty et al., Cancer Lett 235(2):298-308 (2006); Zhao et al., J Immunol Methods 363(2):221-232 (2011).

In one embodiment, an antigen binding domain against CLDN6 is an antigen binding portion, e.g., CDRs, of the antibody IMAB027 (Ganymed Pharmaceuticals), see e.g., clinicaltrial.gov/show/NCT02054351.

In one embodiment, an antigen binding domain against TSHR is an antigen binding portion, e.g., CDRs, of an antibody described in, e.g., U.S. Pat. Nos. 8,603,466; 8,501, 415; or U.S. Pat. No. 8,309,693.

In one embodiment, an antigen binding domain against GPRC5D is an antigen binding portion, e.g., CDRs, of the antibody FAB6300A (R&D Systems); or LS-A4180 (Lifespan Biosciences).

In one embodiment, an antigen binding domain against CD97 is an antigen binding portion, e.g., CDRs, of an antibody described in, e.g., U.S. Pat. No. 6,846,911; de Groot et al., J Immunol 183(6):4127-4134 (2009); or an antibody from R&D:MAB3734.

In one embodiment, an antigen binding domain against ALK is an antigen binding portion, e.g., CDRs, of an antibody described in, e.g., Mino-Kenudson et al., Clin Cancer Res 16(5):1561-1571 (2010).

In one embodiment, an antigen binding domain against polysialic acid is an antigen binding portion, e.g., CDRs, of an antibody described in, e.g., Nagae et al., J Biol Chem 288(47):33784-33796 (2013).

In one embodiment, an antigen binding domain against PLAC1 is an antigen binding portion, e.g., CDRs, of an antibody described in, e.g., Ghods et al., Biotechnol Appl Biochem 2013 doi:10.1002/bab.1177.

In one embodiment, an antigen binding domain against GloboH is an antigen binding portion of the antibody VK9; or an antibody described in, e.g., Kudryashov V et al, Glycoconj J. 15(3):243-9 (1998), Lou et al., Proc Natl Acad Sci USA 111(7):2482-2487 (2014); MBr1: Bremer E-G et al. J Biol Chem 259:14773-14777 (1984).

In one embodiment, an antigen binding domain against NY-BR-1 is an antigen binding portion, e.g., CDRs of an antibody described in, e.g., Jager et al., Appl Immunohistochem Mol Morphol 15(1):77-83 (2007).

In one embodiment, an antigen binding domain against WT-1 is an antigen binding portion, e.g., CDRs, of an antibody described in, e.g., Dao et al., Sci Transl Med 5(176):176ra33 (2013); or WO2012/135854.

In one embodiment, an antigen binding domain against MAGE-A1 is an antigen binding portion, e.g., CDRs, of an antibody described in, e.g., Willemsen et al., J Immunol 174(12):7853-7858 (2005) (TCR– like scFv).

In one embodiment, an antigen binding domain against sperm protein 17 is an antigen binding portion, e.g., CDRs, of an antibody described in, e.g., Song et al., Target Oncol 2013 Aug. 14 (PMID: 23943313); Song et al., Med Oncol 29(4):2923-2931 (2012).

In one embodiment, an antigen binding domain against Tie 2 is an antigen binding portion, e.g., CDRs, of the antibody AB33 (Cell Signaling Technology).

In one embodiment, an antigen binding domain against MAD-CT-2 is an antigen binding portion, e.g., CDRs, of an antibody described in, e.g., PMID: 2450952; U.S. Pat. No. 7,635,753.

In one embodiment, an antigen binding domain against Fos-related antigen 1 is an antigen binding portion, e.g., CDRs, of the antibody 12F9 (Novus Biologicals).

In one embodiment, an antigen binding domain against MelanA/MART1 is an antigen binding portion, e.g., CDRs, of an antibody described in, EP2514766 A2; or U.S. Pat. No. 7,749,719.

In one embodiment, an antigen binding domain against sarcoma translocation breakpoints is an antigen binding portion, e.g., CDRs, of an antibody described in, e.g., Luo et al, EMBO Mol. Med. 4(6):453-461 (2012).

In one embodiment, an antigen binding domain against TRP-2 is an antigen binding portion, e.g., CDRs, of an antibody described in, e.g., Wang et al, J Exp Med. 184(6): 2207-16 (1996).

In one embodiment, an antigen binding domain against CYP1B1 is an antigen binding portion, e.g., CDRs, of an antibody described in, e.g., Maecker et al, Blood 102 (9): 3287-3294 (2003).

In one embodiment, an antigen binding domain against RAGE-1 is an antigen binding portion, e.g., CDRs, of the antibody MAB5328 (EMD Millipore).

In one embodiment, an antigen binding domain against human telomerase reverse transcriptase is an antigen binding portion, e.g., CDRs, of the antibody cat no: LS-B95-100 (Lifespan Biosciences)

In one embodiment, an antigen binding domain against intestinal carboxyl esterase is an antigen binding portion, e.g., CDRs, of the antibody 4F12: cat no: LS-B6190-50 (Lifespan Biosciences).

In one embodiment, an antigen binding domain against mut hsp70-2 is an antigen binding portion, e.g., CDRs, of the antibody Lifespan Biosciences: monoclonal: cat no: LS-C133261-100 (Lifespan Biosciences).

In one embodiment, an antigen binding domain against CD79a is an antigen binding portion, e.g., CDRs, of the antibody Anti-CD79a antibody [HM47/A9] (ab3121), available from Abcam; antibody CD79A Antibody #3351 available from Cell Signalling Technology; or antibody HPA017748-Anti-CD79A antibody produced in rabbit, available from Sigma Aldrich.

In one embodiment, an antigen binding domain against CD79b is an antigen binding portion, e.g., CDRs, of the antibody polatuzumab vedotin, anti-CD79b described in Dornan et al., "Therapeutic potential of an anti-CD79b antibody-drug conjugate, anti-CD79b-vc-MMAE, for the treatment of non-Hodgkin lymphoma" Blood. 2009 Sep. 24; 114(13):2721-9. doi: 10.1182/blood-2009-02-205500. Epub 2009 Jul. 24, or the bispecific antibody Anti-CD79b/CD3 described in "4507 Pre-Clinical Characterization of T Cell-Dependent Bispecific Antibody Anti-CD79b/CD3 As a Potential Therapy for B Cell Malignancies" Abstracts of 56$^{th}$ ASH Annual Meeting and Exposition, San Francisco, CA Dec. 6-9, 2014.

In one embodiment, an antigen binding domain against CD72 is an antigen binding portion, e.g., CDRs, of the antibody J3-109 described in Myers, and Uckun, "An anti-CD72 immunotoxin against therapy-refractory B-lineage acute lymphoblastic leukemia." Leuk Lymphoma. 1995 June; 18(1-2):119-22, or anti-CD72 (10D6.8.1, mIgG1) described in Polson et al., "Antibody-Drug Conjugates for the Treatment of Non-Hodgkin's Lymphoma: Target and Linker-Drug Selection" Cancer Res Mar. 15, 2009 69; 2358.

In one embodiment, an antigen binding domain against LAIR1 is an antigen binding portion, e.g., CDRs, of the antibody ANT-301 LAIR1 antibody, available from ProSpec; or anti-human CD305 (LAIR1) Antibody, available from BioLegend.

In one embodiment, an antigen binding domain against FCAR is an antigen binding portion, e.g., CDRs, of the antibody CD89/FCARAntibody (Catalog #10414-H08H), available from Sino Biological Inc.

In one embodiment, an antigen binding domain against LILRA2 is an antigen binding portion, e.g., CDRs, of the antibody LILRA2 monoclonal antibody (M17), clone 3C7, available from Abnova, or Mouse Anti-LILRA2 antibody, Monoclonal (2D7), available from Lifespan Biosciences.

In one embodiment, an antigen binding domain against CD300LF is an antigen binding portion, e.g., CDRs, of the antibody Mouse Anti-CMRF35-like molecule 1 antibody, Monoclonal[UP-D2, available from BioLegend, or Rat Anti-CMRF35-like molecule 1 antibody, Monoclonal[234903], available from R&D Systems.

In one embodiment, an antigen binding domain against CLEC12A is an antigen binding portion, e.g., CDRs, of the antibody Bispecific T cell Engager (BiTE) scFv-antibody and ADC described in Noordhuis et al., "Targeting of CLEC12A In Acute Myeloid Leukemia by Antibody-Drug-Conjugates and Bispecific CLL-1xCD3 BiTE Antibody" 53$^{rd}$ ASH Annual Meeting and Exposition, Dec. 10-13, 2011, and MCLA-117 (Merus).

In one embodiment, an antigen binding domain against BST2 (also called CD317) is an antigen binding portion, e.g., CDRs, of the antibody Mouse Anti-CD317 antibody, Monoclonal[3H4], available from Antibodies-Online or Mouse Anti-CD317 antibody, Monoclonal [696739], available from R&D Systems.

In one embodiment, an antigen binding domain against EMR2 (also called CD312) is an antigen binding portion, e.g., CDRs, of the antibody Mouse Anti-CD312 antibody, Monoclonal[LS-B8033] available from Lifespan Biosciences, or Mouse Anti-CD312 antibody, Monoclonal available from R&D Systems.

In one embodiment, an antigen binding domain against LY75 is an antigen binding portion, e.g., CDRs, of the antibody Mouse Anti-Lymphocyte antigen 75 antibody, Monoclonal[HD30] available from EMD Millipore or Mouse Anti-Lymphocyte antigen 75 antibody, Monoclonal [A15797] available from Life Technologies.

In one embodiment, an antigen binding domain against GPC3 is an antigen binding portion, e.g., CDRs, of the antibody hGC33 described in Nakano K, Ishiguro T, Konishi H, et al. Generation of a humanized anti-glypican 3 antibody by CDR grafting and stability optimization. Anticancer Drugs. 2010 November; 21(10):907-916, or MDX-1414, HN3, or YP7, all three of which are described in Feng et al., "Glypican-3 antibodies: a new therapeutic target for liver cancer." FEBS Lett. 2014 Jan. 21; 588(2):377-82.

In one embodiment, an antigen binding domain against FCRL5 is an antigen binding portion, e.g., CDRs, of the anti-FcRL5 antibody described in Elkins et al., "FcRL5 as a target of antibody-drug conjugates for the treatment of multiple myeloma" Mol Cancer Ther. 2012 October; 11(10): 2222-32. In one embodiment, an antigen binding domain against FCRL5 is an antigen binding portion, e.g., CDRs, of the anti-FcRL5 antibody described in, for example, WO2001/038490, WO/2005/117986, WO2006/039238, WO2006/076691, WO2010/114940, WO2010/120561, or WO2014/210064.

In one embodiment, an antigen binding domain against IGLL1 is an antigen binding portion, e.g., CDRs, of the antibody Mouse Anti-Immunoglobulin lambda-like polypeptide 1 antibody, Monoclonal[AT1G4] available from Lifespan Biosciences, Mouse Anti-Immunoglobulin lambda-like polypeptide 1 antibody, Monoclonal[HSL11] available from BioLegend.

In one embodiment, the antigen binding domain comprises one, two three (e.g., all three) heavy chain CDRs, HC CDR1, HC CDR2 and HC CDR3, from an antibody listed above, and/or one, two, three (e.g., all three) light chain CDRs, LC CDR1, LC CDR2 and LC CDR3, from an antibody listed above. In one embodiment, the antigen binding domain comprises a heavy chain variable region and/or a variable light chain region of an antibody listed above.

In another aspect, the antigen binding domain comprises a humanized antibody or an antibody fragment. In some aspects, a non-human antibody is humanized, where specific sequences or regions of the antibody are modified to increase similarity to an antibody naturally produced in a human or fragment thereof. In one aspect, the antigen binding domain is humanized.

In an embodiment, the antigen-binding domain of a CAR, e.g., a CAR expressed by a cell of the invention, binds to CD19. CD19 is found on B cells throughout differentiation of the lineage from the pro/pre-B cell stage through the terminally differentiated plasma cell stage. In an embodiment, the antigen binding domain is a murine scFv domain that binds to human CD19, e.g., the antigen binding domain of CTL019 (e.g., SEQ ID NO: 7895). In an embodiment, the antigen binding domain is a humanized antibody or antibody fragment, e.g., scFv domain, derived from the murine CTL019 scFv. In an embodiment, the antigen binding domain is a human antibody or antibody fragment that binds to human CD19. Exemplary scFv domains (and their sequences, e.g., CDRs, VL and VH sequences) that bind to CD19 are provided in Table 14. The scFv domain sequences provided in Table 14 include a light chain variable region (VL) and a heavy chain variable region (VH). The VL and VH are attached by a linker comprising the sequence GGGGSGGGGSGGGGS (SEQ ID NO: 6594), e.g., in the following orientation: VL-linker-VH.

TABLE 14

| Antigen Binding domains that bind CD19 | | | |
|---|---|---|---|
| Antigen | Name | Amino Acid Sequence | SEQ ID NO: |
| CD19 | muCTL019 | DIQMTQTTSSLSASLGDRVTISCRASQDISKYLNWYQQKPDGTVKLLI YHTSRLHSGVPSRFSGSGSGTDYSLTISNLEQEDIATYFCQQGNTLPY TFGGGTKLEITGGGGSGGGGSGGGGSEVKLQESGPGLVAPSQSLSVTC | 7895 |

TABLE 14-continued

Antigen Binding domains that bind CD19

| Antigen | Name | Amino Acid Sequence | SEQ ID NO: |
|---|---|---|---|
| | | TVSGVSLPDYGVSWIRQPPRKGLEWLGVIWGSETTYYNSALKSRLTII KDNSKSQVFLKMNSLQTDDTAIYYCAKHYYYGGSYAMDYWGQGTSVTV SS | |
| CD19 | huscFv1 | EIVMTQSPATLSLSPGERATLSCRASQDISKYLNWYQQKPGQAPRLLI YHTSRLHSGIPARFSGSGSGTDYTLTISSLQPEDFAVYFCQQGNTLPY TFGQGTKLEIKGGGGSGGGGSGGGGSQVQLQESGPGLVKPSETLSLTC TVSGVSLPDYGVSWIRQPPGKGLEWIGVIWGSETTYYSSSLKSRVTIS KDNSKNQVSLKLSSVTAADTAVYYCAKHYYYGGSYAMDYWGQGTLVTV SS | 7883 |
| CD19 | huscFv2 | EIVMTQSPATLSLSPGERATLSCRASQDISKYLNWYQQKPGQAPRLLI YHTSRLHSGIPARFSGSGSGTDYTLTISSLQPEDFAVYFCQQGNTLPY TFGQGTKLEIKGGGGSGGGGSGGGGSQVQLQESGPGLVKPSETLSLTC TVSGVSLPDYGVSWIRQPPGKGLEWIGVIWGSETTYYQSSLKSRVTIS KDNSKNQVSLKLSSVTAADTAVYYCAKHYYYGGSYAMDYWGQGTLVTV SS | 7884 |
| CD19 | huscFv3 | QVQLQESGPGLVKPSETLSLTCTVSGVSLPDYGVSWIRQPPGKGLEWI GVIWGSETTYYSSSLKSRVTISKDNSKNQVSLKLSSVTAADTAVYYCA KHYYYGGSYAMDYWGQGTLVTVSSGGGGSGGGGSGGGGSEIVMTQSPA TLSLSPGERATLSCRASQDISKYLNWYQQKPGQAPRLLIYHTSRLHSG IPARFSGSGSGTDYTLTISSLQPEDFAVYFCQQGNTLPYTFGQGTKLE IK | 7885 |
| CD19 | huscFv4 | QVQLQESGPGLVKPSETLSLTCTVSGVSLPDYGVSWIRQPPGKGLEWI GVIWGSETTYYQSSLKSRVTISKDNSKNQVSLKLSSVTAADTAVYYCA KHYYYGGSYAMDYWGQGTLVTVSSGGGGSGGGGSGGGGSEIVMTQSPA TLSLSPGERATLSCRASQDISKYLNWYQQKPGQAPRLLIYHTSRLHSG IPARFSGSGSGTDYTLTISSLQPEDFAVYFCQQGNTLPYTFGQGTKLE IK | 7886 |
| CD19 | huscFv5 | EIVMTQSPATLSLSPGERATLSCRASQDISKYLNWYQQKPGQAPRLLI YHTSRLHSGIPARFSGSGSGTDYTLTISSLQPEDFAVYFCQQGNTLPY TFGQGTKLEIKGGGGSGGGGSGGGGSGGGGSQVQLQESGPGLVKPSET LSLTCTVSGVSLPDYGVSWIRQPPGKGLEWIGVIWGSETTYYSSSLKS RVTISKDNSKNQVSLKLSSVTAADTAVYYCAKHYYYGGSYAMDYWGQG TLVTVSS | 7887 |
| CD19 | huscFv6 | EIVMTQSPATLSLSPGERATLSCRASQDISKYLNWYQQKPGQAPRLLI YHTSRLHSGIPARFSGSGSGTDYTLTISSLQPEDFAVYFCQQGNTLPY TFGQGTKLEIKGGGGSGGGGSGGGGSGGGGSQVQLQESGPGLVKPSET LSLTCTVSGVSLPDYGVSWIRQPPGKGLEWIGVIWGSETTYYQSSLKS RVTISKDNSKNQVSLKLSSVTAADTAVYYCAKHYYYGGSYAMDYWGQG TLVTVSS | 7888 |
| CD19 | huscFv7 | QVQLQESGPGLVKPSETLSLTCTVSGVSLPDYGVSWIRQPPGKGLEWI GVIWGSETTYYSSSLKSRVTISKDNSKNQVSLKLSSVTAADTAVYYCA KHYYYGGSYAMDYWGQGTLVTVSSGGGGSGGGGSGGGGSGGGGSEIVM TQSPATLSLSPGERATLSCRASQDISKYLNWYQQKPGQAPRLLIYHTS RLHSGIPARFSGSGSGTDYTLTISSLQPEDFAVYFCQQGNTLPYTFGQ GTKLEIK | 7889 |
| CD19 | huscFv8 | QVQLQESGPGLVKPSETLSLTCTVSGVSLPDYGVSWIRQPPGKGLEWI GVIWGSETTYYQSSLKSRVTISKDNSKNQVSLKLSSVTAADTAVYYCA KHYYYGGSYAMDYWGQGTLVTVSSGGGGSGGGGSGGGGSGGGGSEIVM TQSPATLSLSPGERATLSCRASQDISKYLNWYQQKPGQAPRLLIYHTS RLHSGIPARFSGSGSGTDYTLTISSLQPEDFAVYFCQQGNTLPYTFGQ GTKLEIK | 7890 |
| CD19 | huscFv9 | EIVMTQSPATLSLSPGERATLSCRASQDISKYLNWYQQKPGQAPRLLI YHTSRLHSGIPARFSGSGSGTDYTLTISSLQPEDFAVYFCQQGNTLPY TFGQGTKLEIKGGGGSGGGGSGGGGSGGGGSQVQLQESGPGLVKPSET LSLTCTVSGVSLPDYGVSWIRQPPGKGLEWIGVIWGSETTYYNSSLKS RVTISKDNSKNQVSLKLSSVTAADTAVYYCAKHYYYGGSYAMDYWGQG TLVTVSS | 7891 |
| CD19 | HuscFv10 | QVQLQESGPGLVKPSETLSLTCTVSGVSLPDYGVSWIRQPPGKGLEWI GVIWGSETTYYNSSLKSRVTISKDNSKNQVSLKLSSVTAADTAVYYCA KHYYYGGSYAMDYWGQGTLVTVSSGGGGSGGGGSGGGGSGGGGSEIVM TQSPATLSLSPGERATLSCRASQDISKYLNWYQQKPGQAPRLLIYHTS RLHSGIPARFSGSGSGTDYTLTISSLQPEDFAVYFCQQGNTLPYTFGQ GTKLEIK | 7892 |

TABLE 14-continued

Antigen Binding domains that bind CD19

| Antigen | Name | Amino Acid Sequence | SEQ ID NO: |
|---|---|---|---|
| CD19 | HuscFv11 | EIVMTQSPATLSLSPGERATLSCRASQDISKYLNWYQQKPGQAPRLLI YHTSRLHSGIPARFSGSGSGTDYTLTISSLQPEDFAVYFCQQGNTLPY TFGQGTKLEIKGGGGSGGGGSGGGGSQVQLQESGPGLVKPSETLSLTC TVSGVSLPDYGVSWIRQPPGKGLEWIGVIWGSETTYYNSSLKSRVTIS KDNSKNQVSLKLSSVTAADTAVYYCAKHYYYGGSYAMDYWGQGTLVTV SS | 7893 |
| CD19 | HuscFv12 | QVQLQESGPGLVKPSETLSLTCTVSGVSLPDYGVSWIRQPPGKGLEWI GVIWGSETTYYNSSLKSRVTISKDNSKNQVSLKLSSVTAADTAVYYCA KHYYYGGSYAMDYWGQGTLVTVSSGGGGSGGGGSGGGGSEIVMTQSPA TLSLSPGERATLSCRASQDISKYLNWYQQKPGQAPRLLIYHTSRLHSG IPARFSGSGSGTDYTLTISSLQPEDFAVYFCQQGNTLPYTFGQGTKLE IK | 7894 |

The sequences of the CDR sequences of the scFv domains of the CD19 antigen binding domains provided in Table 14 are shown in Table 15 for the heavy chain variable domains and in Table 16 for the light chain variable domains. "ID" stands for the respective SEQ ID NO for each CDR.

TABLE 15

Heavy Chain Variable Domain CDRs

| Description | FW | HCDR1 | ID | HCDR2 | ID | HCDR3 | ID |
|---|---|---|---|---|---|---|---|
| murine_CART19 | | GVSLPDYGVS | 7899 | VIWGSETTYYNSALKS | 7900 | HYYYGGSYAMDY | 7904 |
| humanized_CART19 a | VH4 | GVSLPDYGVS | 7899 | VIWGSETTYY*SS*LKS | 7901 | HYYYGGSYAMDY | 7904 |
| humanized_CART19 b | VH4 | GVSLPDYGVS | 7899 | VIWGSETTYY*QS*LKS | 7902 | HYYYGGSYAMDY | 7904 |
| humanized_CART19 c | VH4 | GVSLPDYGVS | 7899 | VIWGSETTYYNS*S*LKS | 7903 | HYYYGGSYAMDY | 7904 |

TABLE 16

Light Chain Variable Domain CDRs

| Description | FW | LCDR1 | ID | LCDR2 | ID | LCDR3 | ID |
|---|---|---|---|---|---|---|---|
| murine_CART19 | | RASQDISKYLN | 7905 | HTSRLHS | 7906 | QQGNTLPYT | 7907 |
| humanized_CART19 a | VK3 | RASQDISKYLN | 7905 | HTSRLHS | 7906 | QQGNTLPYT | 7907 |
| humanized_CART19 b | VK3 | RASQDISKYLN | 7905 | HTSRLHS | 7906 | QQGNTLPYT | 7907 |
| humanized_CART19 c | VK3 | RASQDISKYLN | 7905 | HTSRLHS | 7906 | QQGNTLPYT | 7907 |

In an embodiment, the antigen binding domain comprises an anti-CD19 antibody, or fragment thereof, e.g., an scFv. For example, the antigen binding domain comprises a variable heavy chain and a variable light chain listed in Table 17. The linker sequence joining the variable heavy and variable light chains can be any of the linker sequences described herein, or alternatively, can be GSTSGSGKPGSGEGSTKG (SEQ ID NO: 8167). The light chain variable region and heavy chain variable region of a scFv can be, e.g., in any of the following orientations: light chain variable region-linker-heavy chain variable region or heavy chain variable region-linker-light chain variable region.

TABLE 17

Additional Anti-CD19 antibody binding domains

| Ab Name | VH Sequence | VL Sequence |
|---|---|---|
| SJ25-C1 | QVQLLESGAELVRPGSSVKISCKASG YAFSSYWMNWVKQRPGQGLEWIGQIY PGDGDTNYNGKFKGQATLTADKSSST AYMQLSGLTSEDSAVYSCARKTISSV VDFYFDYWGQGTTVT (SEQ ID | ELVLTQSPKFMSTVGDRVSVTCKASQNV GTNVAWYQQKPGQSPKPLIYSATYRNSGV PDRFTGSGSGTDFTLTITNVQSKDLADYF YFCQYNRYPYTSGGGTKLEIKRRS (SEQ ID NO: 7897) |

TABLE 17-continued

Additional Anti-CD19 antibody binding domains

NO: 7896)

ScFv Sequence

SJ25-C1 scFv
QVQLLESGAELVRPGSSVKISCKASGYAFSSYWMNWVKQRPGQGLEWIGQIYPGDGD
TNYNGKFKGQATLTADKSSSTAYMQLSGLTSEDSAVYSCARKTISSVVDFYFDYWGQ
GTTVTGSTSGSGKPGSGEGSTKGELVLTQSPKFMSTSVGDRVSVTCKASQNVGTNVA
WYQQKPGQSPKPLIYSATYRNSGVPDRFTGSGSGTDFTLTITNVQSKDLADYFYFCQ
YNRYPYTSGGGTKLEIKRRS (SEQ ID NO: 7898)

In one embodiment, the CD19 binding domain comprises one or more (e.g., all three) light chain complementary determining region 1 (LC CDR1), light chain complementary determining region 2 (LC CDR2), and light chain complementary determining region 3 (LC CDR3) of a CD19 binding domain described herein, e.g., provided in Table 14 or 15, and/or one or more (e.g., all three) heavy chain complementary determining region 1 (HC CDR1), heavy chain complementary determining region 2 (HC CDR2), and heavy chain complementary determining region 3 (HC CDR3) of a CD19 binding domain described herein, e.g., provided in Table 14 or 16. In one embodiment, the CD19 binding domain comprises one, two, or all of LC CDR1, LC CDR2, and LC CDR3 of any amino acid sequences as provided in Table 16, incorporated herein by reference; and one, two or all of HC CDR1, HC CDR2, and HC CDR3 of any amino acid sequences as provided in Table 15.

In one embodiment, the CD19 antigen binding domain comprises:
  (i) (a) a LC CDR1 amino acid sequence of SEQ ID NO: 7905, a LC CDR2 amino acid sequence of SEQ ID NO: 7906, and a LC CDR3 amino acid sequence of SEQ ID NO: 7907; and (b) a HC CDR1 amino acid sequence of SEQ ID NO: 7899, a HC CDR2 amino acid sequence of SEQ ID NO: 7900, and a HC CDR3 amino acid sequence of SEQ ID NO: 7904
  (ii) (a) a LC CDR1 amino acid sequence of SEQ ID NO: 7905, a LC CDR2 amino acid sequence of SEQ ID NO: 7906, and a LC CDR3 amino acid sequence of SEQ ID NO: 7907; and (b) a HC CDR1 amino acid sequence of SEQ ID NO: 7899, a HC CDR2 amino acid sequence of SEQ ID NO: 7901, and a HC CDR3 amino acid sequence of SEQ ID NO: 7904;
  (iii) (a) a LC CDR1 amino acid sequence of SEQ ID NO: 7905, a LC CDR2 amino acid sequence of SEQ ID NO: 7906, and a LC CDR3 amino acid sequence of SEQ ID NO: 7907; and (b) a HC CDR1 amino acid sequence of SEQ ID NO: 7899, a HC CDR2 amino acid sequence of SEQ ID NO: 7902, and a HC CDR3 amino acid sequence of SEQ ID NO: 7904; or
  (iv) (a) a LC CDR1 amino acid sequence of SEQ ID NO: 7905, a LC CDR2 amino acid sequence of SEQ ID NO: 7906, and a LC CDR3 amino acid sequence of SEQ ID NO: 7907; and (b) a HC CDR1 amino acid sequence of SEQ ID NO: 7899, a HC CDR2 amino acid sequence of SEQ ID NO: 7903, and a HC CDR3 amino acid sequence of SEQ ID NO: 7904.

In one embodiment, the CD19 binding domain comprises a light chain variable region described herein (e.g., in Table 14 or 17) and/or a heavy chain variable region described herein (e.g., in Table 14 or 17). In one embodiment, the CD19 binding domain is a scFv comprising a light chain and a heavy chain of an amino acid sequence listed in Table 14 or 17. In one embodiment, the CD19 binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in Table 14 or 17, or a sequence with 95-99% identity with an amino acid sequence provided in Table 14 or 17; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in Table 14 or 17, or a sequence with 95-99% identity to an amino acid sequence provided in Table 14 or 17.

In one embodiment, the CD19 binding domain comprises an amino acid sequence selected from a group consisting of SEQ ID NO: 7883; SEQ ID NO: 7884, SEQ ID NO: 7885; SEQ ID NO: 7886; SEQ ID NO: 7887; SEQ ID NO: 7888; SEQ ID NO: 7889, SEQ ID NO: 7890, SEQ ID NO: 7891, SEQ ID NO: 7892, SEQ ID NO: 7893, SEQ ID NO: 7894, SEQ ID NO: 7895, and SEQ ID NO: 7898; or an amino acid sequence having at least one, two or three modifications (e.g., substitutions, e.g., conservative substitutions) but not more than 30, 20 or 10 modifications (e.g., substitutions, e.g., conservative substitutions) to any of the aforesaid sequences; or a sequence with 95-99% identity to any of the aforesaid sequences. In one embodiment, the CD19 binding domain is a scFv, and a light chain variable region comprising an amino acid sequence described herein, e.g., in Table 14 or 17, is attached to a heavy chain variable region comprising an amino acid sequence described herein, e.g., in Table 14 or 17, via a linker, e.g., a linker described herein. In one embodiment, the CD19 binding domain includes a (Gly4-Ser)n linker, wherein n is 1, 2, 3, 4, 5, or 6, preferably 3 (SEQ ID NO: 10801). The light chain variable region and heavy chain variable region of a scFv can be, e.g., in any of the following orientations: light chain variable region-linker-heavy chain variable region or heavy chain variable region-linker-light chain variable region.

Any known CD19 CAR, e.g., the CD19 antigen binding domain of any known CD19 CAR, in the art can be used in accordance with the instant invention to construct a CAR. For example, LG-740; CD19 CAR described in the U.S. Pat. Nos. 8,399,645; 7,446,190; Xu et al., Leuk Lymphoma. 2013 54(2):255-260(2012); Cruz et al., Blood 122(17): 2965-2973 (2013); Brentjens et al., Blood, 118(18):4817-4828 (2011); Kochenderfer et al., Blood 116(20):4099-102 (2010); Kochenderfer et al., Blood 122 (25):4129-39(2013); and 16th Annu Meet Am Soc Gen Cell Ther (ASGCT) (May 15-18, Salt Lake City) 2013, Abst 10. In one embodiment, an antigen binding domain against CD19 is an antigen binding portion, e.g., CDRs, of a CAR, antibody or antigen-binding fragment thereof described in, e.g., PCT publication WO2012/079000; PCT publication WO2014/153270; Kochenderfer, J. N. et al., J. Immunother. 32 (7), 689-702 (2009); Kochenderfer, J. N., et al., Blood, 116 (20), 4099-4102 (2010); PCT publication WO2014/031687; Bejcek Cancer Research, 55, 2346-2351, 1995; or U.S. Pat. No. 7,446,190.

In an embodiment, the antigen-binding domain of CAR, e.g., a CAR expressed by a cell of the invention, binds to BCMA. BCMA is found preferentially expressed in mature B lymphocytes. In an embodiment, the antigen binding domain is a murine scFv domain that binds to human BCMA. In an embodiment, the antigen binding domain is a humanized antibody or antibody fragment, e.g., scFv domain, that binds human BCMA. In an embodiment, the antigen binding domain is a human antibody or antibody fragment that binds to human BCMA. Exemplary scFv domains (and their sequences, e.g., CDRs, VL and VH sequences) that bind to BCMA are provided in Table 18, Table 19, Table 20 and Table 21. The scFv domain sequences provided in Table 18 and Table 19 include a light chain variable region (VL) and a heavy chain variable region (VH). The VL and VH are attached by a linker, e.g., in the following orientation: VH-linker-VL.

TABLE 18

Antigen Binding domains that bind BCMA
The amino acid sequences variable heavy chain and variable light chain sequences for each scFv is also provided.

| Name/ Description | SEQ ID NO: | Sequence |
|---|---|---|
| 139109 | | |
| 139109-aa ScFv domain | 7949 | EVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSSASGGGGSGGRASGGGGSDIQLTQSPSSLSASVGDR VTITCRASQSISSYLNWYQQKPGKAPKLLIYAASSLQSGVPSRFSGSGSG TDFTLTISSLQPEDFATYYCQQSYSTPYTEGQGTKVEIK |
| 139109-nt ScFv domain | 7964 | GAAGTGCAATTGGTGGAATCAGGGGGAGGACTTGTGCAGCCTGGAGGATC GCTGAGACTGTCATGTGCCGTGTCCGGCTTTGCCCTGTCCAACCACGGGA TGTCCTGGGTCCGCCGCGCGCCTGGAAAGGGCCTCGAATGGGTGTCGGGT ATTGTGTACAGCGGTAGCACCTACTATGCCGCATCCGTGAAGGGAGATT CACCATCAGCCGGGACAACTCCAGGAACACTCTGTACCTCCAAATGAATT CGCTGAGGCCAGAGGACACTGCCATCTACTACTGCTCCGCGCATGGCGGA GAGTCCGACGTCTGGGGACAGGGGACCACCGTGACCGTGTCTAGCGCGTC CGGCGGAGGCGGCAGCGGGGGTCGGGCATCAGGGGGCGGCGGATCGGACA TCCAGCTCACCCAGTCCCCGAGCTCGCTGTCCGCCTCCGTGGGAGATCGG GTCACCATCACGTGCCGCGCCAGCCAGTCGATTTCCTCCTACCTGAACTG GTACCAACAGAAGCCCGGAAAAGCCCCGAAGCTTCTCATCTACGCCGCCT CGAGCCTGCAGTCAGGAGTGCCCTCACGGTTCTCCGGCTCCGGTTCCGGT ACTGATTTCACCCTGACCATTTCCTCCCTGCAACCGGAGGACTTCGCTAC TTACTACTGCCAGCAGTCGTACTCCACCCCCTACACTTTCGGACAAGGCA CCAAGGTCGAAATCAAG |
| 139109-aa VH | 7979 | EVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSS |
| 139109-aa VL | 7994 | DIQLTQSPSSLSASVGDRVTITCRASQSISSYLNWYQQKPGKAPKLLIYA ASSLQSGVPSRFSGSGSGTDFTLTISSLQPEDFATYYCQQSYSTPYTFGQ GTKVEIK |
| 139103 | | |
| 139103-aa ScFv domain | 7939 | QVQLVESGGGLVQPGRSLRLSCAASGFTFSNYAMSWVRQAPGKGLGWVSG ISRSGENTYYADSVKGRFTISRDNSKNTLYLQMNSLRDEDTAVYYCARSP AHYYGGMDVWGQGTTVTVSSASGGGGSGGRASGGGGSDIVLTQSPGTLSL SPGERATLSCRASQSISSSFLAWYQQKPGQAPRLLIYGASRRATGIPDRF SGSGSGTDFTLTISRLEPEDSAVYYCQQYHSSPSWTFGQGTKLEIK |
| 139103-nt ScFv domain | 7954 | CAAGTGCAACTCGTGGAATCTGGTGGAGGACTCGTGCAACCCGGAAGATC GCTTAGACTGTCGTGTGCCGCCAGCGGGTTCACTTTCTCGAACTACGCGA TGTCCTGGGTCCGCCAGGCACCCGGAAAGGGACTCGGTTGGGTGTCCGGC ATTTCCCGGTCCGGCGAAAATACCTACTACGCCGACTCCGTGAAGGGCCG CTTCACCATCTCAAGGGACAACAGCAAAAACACCCTGTACTTGCAAATGA ACTCCCTGCGGGATGAAGATACAGCCGTGTACTATTGCGCCCGGTCGCCT GCCCATTACTACGGCGGAATGGACGTCTGGGGACAGGGAACCACTGTGAC TGTCAGCAGCGCGTCGGGTGGCGGCGGCTCAGGGGGTCGGGCCTCCGGGG GGGAGGGGTCCGACATCGTGCTGACCCAGTCCCCGGGAACCCTGAGCCTG AGCCCGGGAGAGCGCGCGACCCTGTCATGCCGGGCATCCCAGAGCATTAG CTCCTCCTTTCTCGCCTGGTATCAGCAGAAGCCCGGACAGGCCCCGAGGC TGCTGATCTACGGCGCTAGCAGAAGGGCTACCGGAATCCCAGACCGGTTC TCCGGCTCCGGTTCCGGGACCGATTTCACCCTTACTATCTCGCGCCTGGA ACCTGAGGACTCCGCCGTCTACTACTGCCAGCAGTACCACTCATCCCCGT CGTGGACGTTCGGACAGGGCACCAAGCTGGAGATTAAG |

TABLE 18-continued

Antigen Binding domains that bind BCMA
The amino acid sequences variable heavy chain and variable light chain
sequences for each scFv is also provided.

| Name/<br>Description | SEQ ID<br>NO: | Sequence |
| --- | --- | --- |
| 139103-aa<br>VH | 7969 | QVQLVESGGGLVQPGRSLRLSCAASGFTFSNYAMSWVRQAPGKGLGWVSG<br>ISRSGENTYYADSVKGRFTISRDNSKNTLYLQMNSLRDEDTAVYYCARSP<br>AHYYGGMDVWGQGTTVTVSS |
| 139103-aa<br>VL | 7984 | DIVLTQSPGTLSLSPGERATLSCRASQSISSSFLAWYQQKPGQAPRLLIY<br>GASRRATGIPDRFSGSGSGTDFTLTISRLEPEDSAVYYCQQYHSSPSWTF<br>GQGTKLEIK |

139105

| 139105-aa<br>ScFv domain | 7940 | QVQLVESGGGLVQPGRSLRLSCAASGFTFDDYAMHWVRQAPGKGLEWVSG<br>ISWNSGSIGYADSVKGRFTISRDNAKNSLYLQMNSLRAEDTALYYCSVHS<br>FLAYWGQGTLVTVSSASGGGGSGGRASGGGGSDIVMTQTPLSLPVTPGEP<br>ASISCRSSQSLLHSNGYNYLDWYLQKPGQSPQLLIYLGSNRASGVPDRFS<br>GSGSGTDFTLKISRVEAEDVGVYYCMQALQTPYTFGQGTKVEIK |
| --- | --- | --- |
| 139105-nt<br>ScFv domain | 7955 | CAAGTGCAACTCGTCGAATCCGGTGGAGGTCTGGTCCAACCTGGTAGAAG<br>CCTGAGACTGTCGTGTGCGGCCAGCGGATTCACCTTTGATGACTATGCTA<br>TGCACTGGGTGCGGCAGGCCCCAGGAAAGGGCCTGGAATGGGTGTCGGGA<br>ATTAGCTGGAACTCCGGGTCCATTGGCTACGCCGACTCCGTGAAGGGCCG<br>CTTCACCATCTCCCGCGACAACGCAAAGAACTCCCTGTACTTGCAAATGA<br>ACTCGCTCAGGGCTGAGGATACCGCGCTGTACTACTGCTCCGTGCATTCC<br>TTCCTGGCCTACTGGGGACAGGGAACTCTGGTCACCGTGTCGAGCGCCTC<br>CGGCGGCGGGGGCTCGGGTGGACGGGCCTCGGGCGGAGGGGGTCCGACA<br>TCGTGATGACCCAGACCCCGCTGAGCTTGCCCGTGACTCCCGGAGAGCCT<br>GCATCCATCTCCTGCCGGTCATCCCAGTCCCTTCTCCACTCCAACGGATA<br>CAACTACCTCGACTGGTACCTCCAGAAGCCGGGACAGAGCCCTCAGCTTC<br>TGATCTACCTGGGGTCAAATAGAGCCTCAGGAGTGCCGGATCGGTTCAGC<br>GGATCTGGTTCGGGAACTGATTTCACTCTGAAGATTTCCCGCGTGGAAGC<br>CGAGGACGTGGGCGTCTACTACTGTATGCAGGCGCTGCAGACCCCCTATA<br>CCTTCGGCCAAGGGACGAAAGTGGAGATCAAG |
| 139105-aa<br>VH | 7970 | QVQLVESGGGLVQPGRSLRLSCAASGFTFDDYAMHWVRQAPGKGLEWVSG<br>ISWNSGSIGYADSVKGRFTISRDNAKNSLYLQMNSLRAEDTALYYCSVHS<br>FLAYWGQGTLVTVSS |
| 139105-aa<br>VL | 7985 | DIVMTQTPLSLPVTPGEPASISCRSSQSLLHSNGYNYLDWYLQKPGQSPQ<br>LLIYLGSNRASGVPDRFSGSGSGTDFTLKISRVEAEDVGVYYCMQALQTP<br>YTFGQGTKVEIK |

139111

| 139111-aa<br>ScFv domain | 7941 | EVQLLESGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSSASGGGGSGGRASGGGGSDIVMTQTPLSLSVTPGQP<br>ASISCKSSQSLLRNDGKTPLYWYLQKAGQPPQLLIYEVSNRFSGVPDRFS<br>GSGSGTDFTLKISRVEAEDVGAYYCMQNIQFPSFGGGTKLEIK |
| --- | --- | --- |
| 139111-nt<br>ScFv domain | 7956 | GAAGTGCAATTGTTGGAATCTGGAGGAGGACTTGTGCAGCCTGGAGGATC<br>ACTGAGACTTTCGTGTGCGGTGTCAGGCTTCGCCCTGAGCAACCACGGCA<br>TGAGCTGGGTGCGGAGAGCCCCGGGGAAGGGTCTGGAATGGGTGTCCGGG<br>ATCGTCTACTCCGGTTCAACTTACTACGCCGCAAGCGTGAAGGGTCGCTT<br>CACCATTTCCCGCGATAACTCCCGGAACACCCTGTACCTCCAAATGAACT<br>CCCTGCGGCCCGAGGACACCGCCATCTACTACTGTTCCGCGCATGGAGGA<br>GAGTCCGATGTCTGGGGACAGGGCACTACCGTGACCGTGTCGAGCGCCTC<br>GGGGGGAGGAGGCTCCGGCGGTCGCGCCTCCGGGGGGGTGGCAGCGACA<br>TTGTGATGACGCAGACTCCACTCTCGCTGTCCGTGACCCCGGGACAGCCC<br>GCGTCCATCTCGTGCAAGAGCTCCCAGAGCCTGCTGAGGAACGACGGAAA<br>GACTCCTCTGTATTGGTACCTCCAGAAGGCTGGACAGCCCCCGCAACTGC<br>TCATCTACGAAGTGTCAAATCGCTTCTCCGGGGTGCCGGATCGGTTTTCC<br>GGCTCGGATCGGGCACCGACTTCACCCTGAAAATCTCCAGGGTCGAGGC<br>CGAGGACGTGGGAGCCTACTACTGCATGCAAAACATCCAGTTCCCTTCCT<br>TCGGCGGCGGCACAAAGCTGGAGATTAAG |
| 139111-aa<br>VH | 7971 | EVQLLESGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSS |
| 139111-aa<br>VL | 7986 | DIVMTQTPLSLSVTPGQPASISCKSSQSLLRNDGKTPLYWYLQKAGQPPQ<br>LLIYEVSNRFSGVPDRFSGSGSGTDFTLKISRVEAEDVGAYYCMQNIQFP<br>SFGGGTKLEIK |

TABLE 18-continued

Antigen Binding domains that bind BCMA
The amino acid sequences variable heavy chain and variable light chain sequences for each scFv is also provided.

| Name/ Description | SEQ ID NO: | Sequence |
|---|---|---|
| 139100 | | |
| 139100-aa ScFv domain | 7942 | QVQLVQSGAEVRKTGASVKVSCKASGYIFDNEGINWVRQAPGQGLEWMGW INPKNNNTNYAQKFQGRVTITADESTNTAYMEVSSLRSEDTAVYYCARGP YYYQSYMDVWGQGTMVTVSSASGGGGSGGRASGGGGSDIVMTQTPLSLPV TPGEPASISCRSSQSLLHSNGYNYLNWYLQKPGQSPQLLIYLGSKRASGV PDRFSGSGSGTDFTLHITRVGAEDVGVYYCMQALQTPYTFGQGTKLEIK |
| 139100-nt ScFv domain | 7957 | CAAGTCCAACTCGTCCAGTCCGGCGCAGAAGTCAGAAAAACCGGTGCTAG CGTGAAAGTGTCCTGCAAGGCCTCCGGCTACATTTTCGATAACTTCGGAA TCAACTGGGTCAGACAGGCCCCGGGCCAGGGGCTGGAATGGATGGGATGG ATCAACCCCAAGAACAACAACACCAACTACGCACAGAAGTTCCAGGGCCG CGTGACTATCACCGCCGATGAATCGACCAATACCGCCTACATGGAGGTGT CCTCCCTGCGGTCGGAGGACACTGCCGTGTATTACTGCGCGAGGGGCCCA TACTACTACCAAAGCTACATGGACGTCTGGGGACAGGGAACCATGGTGAC CGTGTCATCCGCCTCCGGTGGTGGAGGCTCCGGGGGGCGGGCTTCAGGAG GCGGAGGAAGCGATATTGTGATGACCCAGACTCCGCTTAGCCTGCCCGTG ACTCCTGGAGAACCGGCCTCCATTTCCTGCCGGTCCTCGCAATCACTCCT GCATTCAACGGTTACAACTACCTGAATTGGTACCTCCAGAAGCCTGGCC AGTCGCCCCAGTTGCTGATCTATCTGGGCTCGAAGCGCGCCTCCGGGGTG CCTGACCGGTTTAGCGGATCTGGGAGCGGCACGGACTTCACTCTCCACAT CACCCGCGTGGGAGCGGAGGACGTGGGAGTGTACTACTGTATGCAGGCGC TGCAGACTCCGTACACATTCGGACAGGGCACCAAGCTGGAGATCAAG |
| 139100-aa VH | 7972 | QVQLVQSGAEVRKTGASVKVSCKASGYIFDNFGINWVRQAPGQGLEWMGW INPKNNNTNYAQKFQGRVTITADESTNTAYMEVSSLRSEDTAVYYCARGP YYYQSYMDVWGQGTMVTVSS |
| 139100-aa VL | 7987 | DIVMTQTPLSLPVTPGEPASISCRSSQSLLHSNGYNYLNWYLQKPGQSPQ LLIYLGSKRASGVPDRFSGSGSGTDFTLHITRVGAEDVGVYYCMQALQTP YTFGQGTKLEIK |
| 139101 | | |
| 139101-aa ScFv domain | 7943 | QVQLQESGGGLVQPGGSLRLSCAASGFTFSSDAMTWVRQAPGKGLEWVSV ISGSGGTTYYADSVKGRFTISRDNSKNTLYLQMNSLRAEDTAVYYCAKLD SSGYYYARGPRYWGQGTLVTVSSASGGGGSGGRASGGGGSDIQLTQSPSS LSASVGDRVTITCRASQSISSYLNWYQQKPGKAPKLLIYGASTLASGVPA RFSGSGSGTHFTLTINSLQSEDSATYYCQQSYKRASFGQGTKVEIK |
| 139101-nt ScFv domain | 7958 | CAAGTGCAACTTCAAGAATCAGGCGGAGGACTCGTGCAGCCCGGAGGATC ATTGCGGCTCTCGTGCGCCGCCTCGGGCTTCACCTTCTCGAGCGACGCCA TGACCTGGGTCCGCCAGGCCCCGGGGAAGGGGCTGGAATGGGTGTCTGTG ATTTCCGGCTCCGGGGGAACTACGTACTACGCCGATTCCGTGAAAGGTCG CTTCACTATCTCCCGGGACAACAGCAAGAACACCCTTTATCTGCAAATGA ATTCCCTCCGCGCCGAGGACACCGCCGTGTACTACTGCGCCAAGCTGGAC TCCTCGGGCTACTACTATGCCCGGGGTCCGAGATACTGGGGACAGGGAAC CCTCGTGACCGTGTCCTCCGCGTCCGGCGGAGGAGGGTCGGGAGGGCGGG CCTCCGGCGGCGGCGGTTCGGACATCCAGCTGACCCAGTCCCCATCCTCA CTGAGCGCAAGCGTGGGCGACAGAGTCACCATTACATGCAGGGCGTCCCA GAGCATCAGCTCCTACCTGAACTGGTACCAACAGAAGCCTGGAAAGGCTC CTAAGCTGTTGATCTACGGGGCTTCGACCCTGGCATCCGGGGTGCCCGCG AGGTTTAGCGGAAGCGGTAGCGGCACTCACTTCACTCTGACCATTAACAG CCTCCAGTCCGAGGATTCAGCCACTTACTACTGTCAGCAGTCCTACAAGC GGGCCAGCTTCGGACAGGGCACTAAGGTCGAGATCAAG |
| 139101-aa VH | 7973 | QVQLQESGGGLVQPGGSLRLSCAASGFTFSSDAMTWVRQAPGKGLEWVSV ISGSGGTTYYADSVKGRFTISRDNSKNTLYLQMNSLRAEDTAVYYCAKLD SSGYYYARGPRYWGQGTLVTVSS |
| 139101-aa VL | 7988 | DIQLTQSPSSLSASVGDRVTITCRASQSISSYLNWYQQKPGKAPKLLIYG ASTLASGVPARFSGSGSGTHFTLTINSLQSEDSATYYCQQSYKRASFGQG TKVEIK |
| 139102 | | |
| 139102-aa ScFv domain | 7944 | QVQLVQSGAEVKKPGASVKVSCKASGYTFSNYGITWVRQAPGQGLEWMGW ISAYNGNTNYAQKFQGRVTMTRNTSISTAYMELSSLRSEDTAVYYCARGP YYYYMDVWGKGTMVTVSSASGGGGSGGRASGGGGSEIVMTQSPLSLVTP GEPASISCRSSQSLLYSNGYNYVDWYLQKPGQSPQLLIYLGSNRASGVPD RFSGSGSGTDFKLQISRVEAEDVGIYYCMQGRQFPYSFGQGTKVEIK |

TABLE 18-continued

Antigen Binding domains that bind BCMA
The amino acid sequences variable heavy chain and variable light chain
sequences for each scFv is also provided.

| Name/<br>Description | SEQ ID<br>NO: | Sequence |
|---|---|---|
| 139102-nt<br>ScFv domain | 7959 | CAAGTCCAACTGGTCCAGAGCGGTGCAGAAGTGAAGAAGCCCGGAGCGAG<br>CGTGAAAGTGTCCTGCAAGGCTTCCGGGTACACCTTCTCCAACTACGGCA<br>TCACTTGGGTGCGCCAGGCCCCGGGACAGGGCCTGGAATGGATGGGGTGG<br>ATTTCCGCGTACAACGGCAATACGAACTACGCTCAGAAGTTCCAGGGTAG<br>AGTGACCATGACTAGGAACACCTCCATTTCCACCGCCTACATGGAACTGT<br>CCTCCCTGCGGAGCGAGGACACCGCCGTGTACTATTGCGCCCGGGGACCA<br>TACTACTACTACATGGATGTCTGGGGGAAGGGGACTATGGTCACCGTGTC<br>ATCCGCCTCGGGAGGCGGCGGATCAGGAGGACGCGCCTCTGGTGGTGGAG<br>GATCGGAGATCGTGATGACCCAGAGCCCTCTCTCCTTGCCCGTGACTCCT<br>GGGGAGCCCGCATCCATTTCATGCCGGAGCTCCCAGTCACTTCTCTACTC<br>CAACGGCTATAACTACGTGGATTGGTACCTCCAAAAGCCGGGCCAGAGCC<br>CGCAGCTGCTGATCTACCTGGGCTCGAACAGGGCCAGCGGAGTGCCTGAC<br>CGGTTCTCCGGGTCGGGAAGCGGGACCGACTTCAAGCTGCAAATCTCGAG<br>AGTGGAGGCCGAGGACGTGGGAATCTACTACTGTATGCAGGGCCGCCAGT<br>TTCCGTACTCGTTCGGACAGGGCACCAAAGTGGAAATCAAG |
| 139102-aa<br>VH | 7974 | QVQLVQSGAEVKKPGASVKVSCKASGYTFSNYGITWVRQAPGQGLEWMGW<br>ISAYNGNTNYAQKFQGRVTMTRNTSISTAYMELSSLRSEDTAVYYCARGP<br>YYYYMDVWGKGTMVTVSS |
| 139102-aa<br>VL | 7989 | EIVMTQSPLSLPVTPGEPASISCRSSQSLLYSNGYNYVDWYLQKPGQSPQ<br>LLIYLGSNRASGVPDRFSGSGSGTDFKLQISRVEAEDVGIYYCMQGRQFP<br>YSFGQGTKVEIK |
| 139104 | | |
| 139104-aa<br>ScFv domain | 7945 | EVQLLETGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSSASGGGGSGGRASGGGGSEIVLTQSPATLSVSPGES<br>ATLSCRASQSVSSNLAWYQQKPGQAPRLLIYGASTRASGIPDRFSGSGSG<br>TDFTLTISSLQAEDVAVYYCQQYGSSLTFGGGTKVEIK |
| 139104-nt<br>ScFv domain | 7960 | GAAGTGCAATTGCTCGAAACTGGAGGAGGTCTGGTGCAACCTGGAGGATC<br>ACTTCGCCTGTCCTGCGCCGTGTCGGGCTTTGCCCTGTCCAACCATGGAA<br>TGAGCTGGGTCCGCCGCGCGCCGGGGAAGGGCCTCGAATGGGTGTCCGGC<br>ATCGTCTACTCCGGCTCCACCTACTACGCCGCGTCCGTGAAGGGCCGGTT<br>CACGATTTCACGGGACAACTCGCGGAACACCCTGTACCTCCAAATGAATT<br>CCCTTCGGCCGGAGGATACTGCCATCTACTACTGCTCCGCCCACGGTGGC<br>GAATCCGACGTCTGGGGCCAGGGAACCACCGTGACCGTGTCCAGCGCGTC<br>CGGGGGAGGAGGAAGCGGGGGTAGAGCATCGGGTGGAGGCGGATCAGAGA<br>TCGTGCTGACCCAGTCCCCCGCCACCTTGAGCGTGTCACCAGGAGAGTCC<br>GCCACCCTGTCATGCCGCGCCAGCCAGTCCGTGTCCTCCAACCTGGCTTG<br>GTACCAGCAGAAGCCGGGGCAGGCCCCTAGACTCCTGATCTATGGGGCGT<br>CGACCCGGGCATCTGGAATTCCCGATAGGTTCAGCGGATCGGGCTCGGGC<br>ACTGACTTCACTCTGACCATCTCCTCGCTGCAAGCCGAGGACGTGGCTGT<br>GTACTACTGTCAGCAGTACGGAAGCTCCCTGACTTTCGGTGGCGGGACCA<br>AAGTCGAGATTAAG |
| 139104-aa<br>VH | 7975 | EVQLLETGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSS |
| 139104-aa<br>VL | 7990 | EIVLTQSPATLSVSPGESAILSCHASQSYSSNLAWYQQKPGQAPRLLIYG<br>ASTRASGIPDRFSGSGSGTDFTLTISSLQAEDVAVYYCQQYGSSLTFGGG<br>TKVEIK |
| 139106 | | |
| 139106-aa<br>ScFv domain | 7946 | EVQLVETGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSSASGGGGSGGRASGGGGSEIVMTQSPATLSVSPGER<br>ATLSCRASQSVSSKLAWYQQKPGQAPRLLMYGASIRATGIPDRFSGSGSG<br>TEFTLTISSLEPEDFAVYYCQQYGSSSWTFGQGTKVEIK |
| 139106-nt<br>ScFv domain | 7961 | GAAGTGCAATTGGTGGAAACTGGAGGAGGACTTGTGCAACCTGGAGGATC<br>ATTGAGACTGAGCTGCGCAGTGTCGGATTCGCCCTGAGCAACCATGGAA<br>TGTCCTGGGTCAGAAGGGCCCCTGGAAAAGGCCTCGAATGGGTGTCAGGG<br>ATCGTGTACTCCGGTTCCACTTACTACGCCGCTCCGTGAAGGGGCGCTT<br>CACTATCTCACGGGATAACTCCCGCAATACCCTGTACCTCCAAATGAACA<br>GCCTGCGGCCGAGGATACCGCCATCTACTACTGTTCCGCCCACGGTGGA<br>GAGTCTGACGTCTGGGGCCAGGGAACTACCGTGACCGTGTCCTCCGCGTC<br>CGGCGGTGGAGGGAGCGGCGGCCGCGCCAGCGGCGGCGGAGGCTCCGAGA<br>TCGTGATGACCCAGAGCCCCGCTACTCTGTCGGTGTCGCCCGGAGAAAGG |

TABLE 18-continued

Antigen Binding domains that bind BCMA
The amino acid sequences variable heavy chain and variable light chain sequences for each scFv is also provided.

| Name/<br>Description | SEQ ID<br>NO: | Sequence |
|---|---|---|
| | | GCGACCCTGTCCTGCCGGGCGTCGCAGTCCGTGAGCAGCAAGCTGGCTTG<br>GTACCAGCAGAAGCCGGGCCAGGCACCACGCCTGCTTATGTACGGTGCCT<br>CCATTCGGGCCACCGGAATCCCGGACCGGTTCTCGGGGTCGGGGTCCGGT<br>ACCGAGTTCACACTGACCATTTCCTCGCTCGAGCCCGAGGACTTTGCCGT<br>CTATTACTGCCAGCAGTACGGCTCCTCCTCATGGACGTTCGGCCAGGGGA<br>CCAAGGTCGAAATCAAG |
| 139106-aa<br>VH | 7976 | EVQLVETGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSS |
| 139106-aa<br>VL | 7991 | EIVMTQSPATLSVSPGERATLSCRASQSVSSKLAWYQQKPGQAPRLLMYG<br>ASIRATGIPDRFSGSGSGTEFTLTISSLEPEDFAVYYCQQYGSSSWTFGQ<br>GTKVEIK |
| | | 139107 |
| 139107-aa<br>ScFv domain | 7947 | EVQLVETGGGVVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSSASGGGGSGGRASGGGGSEIVLTQSPGTLSLSPGER<br>ATLSCRASQSVGSTNLAWYQQKPGQAPRLLIYDASNRATGIPDRFSGGGS<br>GTDFTLTISRLEPEDFAVYYCQQYGSSPPWTFGQGTKVEIK |
| 139107-nt<br>ScFv domain | 7962 | GAAGTGCAATTGGTGGAGACTGGAGGAGGAGTGGTGCAACCTGGAGGAAG<br>CCTGAGACTGTCATGCGCGGTGTCGGGCTTCGCCCTCTCCAACCACGGAA<br>TGTCCTGGGTCCGCCGGGCCCCTGGGAAAGGACTTGAATGGGTGTCCGGC<br>ATCGTGTACTCGGGTTCCACCTACTACGCGGCCTCAGTGAAGGGCCGGTT<br>TACTATTAGCCGCGACAACTCCAGAAACACACTGTACCTCCAAATGAACT<br>CGCTGCGGCCGGAAGATACCGCTATCTACTACTGCTCCGCCCATGGGGGA<br>GAGTCGGACGTCTGGGGACAGGGCACCACTGTCACTGTGTCCAGCGCTTC<br>CGGCGGTGGTGGAAGCGGGGGACGGGCCTCAGGAGGCGGTGGCAGCGAGA<br>TTGTGCTGACCCAGTCCCCGGGACCCTGAGCCTGTCCCGGGAGAAAGG<br>GCCACCCTCTCCTGTCGGGCATCCCAGTCCGTGGGGTCTACTAACCTTGC<br>ATGGTACCAGCAGAAGCCCGGCCAGGCCCCTCGCCTGCTGATCTACGACG<br>CGTCCAATAGAGCCACCGGCATCCCGGATCGCTTCAGCGGAGGCGGATCG<br>GGCACCGACTTCACCCTCACCATTTCAAGGCTGGAACCGGAGGACTTCGC<br>CGTGTACTACTGCCAGCAGTATGGTTCGTCCCCACCCTGGACGTTCGGCC<br>AGGGGACTAAGGTCGAGATCAAG |
| 139107-aa<br>VH | 7977 | EVQLVETGGGVVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSS |
| 139107-aa<br>VL | 7992 | EIVLTQSPGTLSLSPGERATLSCRASQSVGSTNLAWYQQKPGQAPRLLIY<br>DASNRATGIPDRFSGGGSGTDFTLTISRLEPEDFAVYYCQQYGSSPPWTF<br>GQGTKVEIK |
| | | 139108 |
| 139108-aa<br>ScFv domain | 7948 | QVQLVESGGGLVKPGGSLRLSCAASGFTFSDYYMSWIRQAPGKGLEWVSY<br>ISSSGSTIYYADSVKGRFTISRDNAKNSLYLQMNSLRAEDTAVYYCARES<br>GDGMDVWGQGTTVTVSSASGGGGSGGRASGGGGSDIQMTQSPSSLSASVG<br>DRVTITCRASQSISSYLNWYQQKPGKAPKLLIYAASSLQSGVPSRFSGSG<br>SGTDFTLTISSLQPEDFATYYCQQSYTLAFGQGTKVDIK |
| 139108-nt<br>ScFv domain | 7963 | CAAGTGCAACTCGTGGAATCTGGTGGAGGACTCGTGAAACCTGGAGGATC<br>ATTGAGACTGTCATGCGCGGCCTCGGGATTCACGTTCTCCGATTACTACA<br>TGAGCTGGATTCGCCAGGCTCCGGGGAAGGGACTGGAATGGGTGTCCTAC<br>ATTTCCTCATCCGGCTCCACCATCTACTACGCGGACTCCGTGAAGGGGAG<br>ATTCACCATTAGCCGCGATAACGCCAAGAACAGCCTGTACCTTCAGATGA<br>ACTCCCTGCGGGCTGAAGATACTGCCGTCTACTACTGCGCAAGGGAGAGC<br>GGAGATGGGATGGACGTCTGGGACAGGGTACCACTGTGACCGTGTCGTC<br>GGCCTCCGGCGGAGGGGGTTCGGGTGGAAGGGCCAGCGGCGGCGGAGGCA<br>GCGACATCCAGATGACCCAGTCCCCCTCATCGCTGTCCGCCTCCGTGGGC<br>GACCGCGTCACCATCACATGCCGGGCCTCACAGTCGATCTCCTCCTACCT<br>CAATTGGTATCAGCAGAAGCCCGGAAAGGCCCCTAAGCTTCTGATCTACG<br>CAGCGTCCTCCCTGCAATCCGGGGTCCCATCTCGGTTCTCCGGCTCGGGC<br>AGCGGTACCGACTTCACTCTGACCATCTCCGAGCCTGCAGCCGGAGGACTT<br>CGCCACTTACTACTGTCAGCAAAGCTACACCCTCGCGTTTGGCCAGGGCA<br>CCAAAGTGGACATCAAG |

TABLE 18-continued

Antigen Binding domains that bind BCMA
The amino acid sequences variable heavy chain and variable light chain
sequences for each scFv is also provided.

| Name/ Description | SEQ ID NO: | Sequence |
|---|---|---|
| 139108-aa VH | 7978 | QVQLVESGGGLVKPGGSLRLSCAASGFTFSDYYMSWIRQAPGKGLEWVSY ISSSGSTIYYADSVKGRFTISRDNAKNSLYLQMNSLRAEDTAVYYCARES GDGMDVWGQGTTVTVSS |
| 139108-aa VL | 7993 | DIQMTQSPSSLSASVGDRVTITCRASQSISSYLNWYQQKPGKAPKLLIYA ASSLQSGVPSRFSGSGSGTDFTLTISSLQPEDFATYYCQQSYTLAFGQGT KVDIK |

139110

| Name/ Description | SEQ ID NO: | Sequence |
|---|---|---|
| 139110-aa ScFv domain | 7950 | QVQLVQSGGGLVKPGGSLRLSCAASGFTFSDYYMSWIRQAPGKGLEWVSY ISSSGNTIYYADSVKGRFTISRDNAKNSLYLQMNSLRAEDTAVYYCARST MVREDYWGQGTLVTVSSASGGGGSGGRASGGGGSDIVLTQSPLSLPVTLG QPASISCKSSESLVHNSGKTYLNWFHQRPGQSPRRLIYEVSNRDSGVPDR FTGSGSGTDFTLKISRVEAEDVGVYYCMQGTHWPGTFGQGTKLEIK |
| 139110-nt ScFv domain | 7965 | CAAGTGCAACTGGTGCAAAGCGGAGGAGGATTGGTCAAACCCGGAGGAAG CCTGAGACTGTCATGCGCGGCCTCTGGATTCACCTTCTCCGATTACTACA TGTCATGGATCAGACAGGCCCCGGGGAAGGGCCTCGAATGGGTGTCCTAC ATCTCGTCCTCGGGAACACCATCTACTACGCCGACAGCGTGAAGGGCCG CTTTACCATTTCCCGCGACAACGCAAAGAACTCGCTGTACCTTCAGATGA ATTCCCTGCGGGCTGAAGATACCGCGGTGTACTATTGCGCCCGGTCCACT ATGGTCCGGGAGGACTACTGGGGACAGGGCACACTCGTGACCGTGTCCAG CGCGAGCGGGGTGGAGGCAGCGGTGGACGCGCCTCCGGCGGCGGCGGTT CAGACATCGTGCTGACTCAGTCGCCCCTGTCGCTGCCGGTCACCCTGGGC CAACCGGCCTCAATTAGCTGCAAGTCCTCGGAGAGCCTGGTGCACAACTC AGGAAAGACTTACCTGAACTGGTTCCATCAGCGGCCTGGACAGTCCCCAC GGAGGCTCATCTATGAAGTGTCCAACAGGGATTCGGGGGTGCCCGACCGC TTCACTGGCTCCGGGTCCGGCACCGACTTCACCTTGAAAATCTCCAGAGT GGAAGCCGAGGACGTGGGCGTGTACTACTGTATGCAGGGTACCCACTGGC CTGGAACCTTTGGACAAGGAACTAAGCTCGAGATTAAG |
| 139110-aa VH | 7980 | QVQLVQSGGGLVKPGGSLRLSCAASGFTFSDYYMSWIRQAPGKGLEWVSY ISSSGNTIYYADSVKGRFTISRDNAKNSLYLQMNSLRAEDTAVYYCARST MVREDYWGQGTLVTVSS |
| 139110-aa VL | 7995 | DIVLTQSPLSLPVTLGQPASISCKSSESLVHNSGKTYLNWFHQRPGQSPR RLIYEVSNRDSGVPDRFTGSGSGTDFTLKISRVEAEDVGVYYCMQGTHWP GTFGQGTKLEIK |

139112

| Name/ Description | SEQ ID NO: | Sequence |
|---|---|---|
| 139112-aa ScFv domain | 7951 | QVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSSASGGGGSGGRASGGGGSDIRLTQSPSPLSASVGDR VTITCQASEDINKFLNWYHQTPGKAPKLLIYDASTLQTGVPSRFSGSGSG TDFTLTINSLQPEDIGTYYCQQYESLPLTFGGGTKVEIK |
| 139112-nt ScFv domain | 7966 | CAAGTGCAACTCGTGGAATCTGGTGGAGGACTCGTGCAACCCGGTGGAAG CCTTAGGCTGTCGTGCGCCGTCAGCGGGTTTGCTCTGAGCAACCATGGAA TGTCCTGGGTCCGCCGGGCACCGGGAAAAGGGCTGGAATGGGTGTCCGGC ATCGTGTACAGCGGGTCAACCTATTACGCCGCGTCCGTGAAGGGCAGATT CACTATCTCAAGAGACAACAGCCGGAACACCCTGTACTTGCAAATGAATT CCCTGCGCCCCGAGGACACCGCCATCTACTACTGCTCCGCCCACGGAGGA GAGTCGGACGTGTGGGGCCAGGGAACGACTGTGACTGTGTCCAGCGCATC AGGAGGGGGTGGTTCGGGCGGCCGGGCCTCGGGGGGAGGAGGTTCCGACA TTCGGCTGACCCAGTCCCCGTCCCCACTGTCGGCCTCCGTCGGCGACCGC GTGACCATCACTTGTCAGGCGTCCGAGGACATTAACAAGTTCCTGAACTG GTACCACCAGACCCCTGGAAAGGCCCCCAAGCTGCTGATCTACGATGCCT CGACCCTTCAAACTGGAGTGCCTAGCCGGTTCTCCGGGTCCGGCTCCGGC ACTGATTTCACTCTGACCATCAACTCATTGCAGCCGGAAGATATCGGGAC CTACTATTGCCAGCAGTACGAATCCCTCCCGCTCACATTCGGCGGGGAA CCAAGGTCGAGATTAAG |
| 139112-aa VH | 7981 | QVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSS |
| 139112-aa VL | 7996 | DIRLTQSPSPLSASVGDRVTITCQASEDINKFLNWYHQTPGKAPKLLIYD ASTLQTGVPSRFSGSGSGTDFTLTINSLQPEDIGTYYCQQYESLPLTFGG GTKVEIK |

TABLE 18-continued

Antigen Binding domains that bind BCMA
The amino acid sequences variable heavy chain and variable light chain
sequences for each scFv is also provided.

| Name/<br>Description | SEQ ID<br>NO: | Sequence |
|---|---|---|
| | | 139113 |
| 139113-aa<br>ScFv domain | 7952 | EVQLVETGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSSASGGGGSGGRASGGGGSETTLTQSPATLSVSPGER<br>ATLSCRASQSVGSNLAWYQQKPGQGPRLLIYGASTRATGIPARESGSGSG<br>TEFTLTISSLQPEDFAVYYCQQYNDWLPVTFGQGTKVEIK |
| 139113-nt<br>ScFv domain | 7967 | GAAGTGCAATTGGTGGAAACTGGAGGAGGACTTGTGCAACCTGGAGGATC<br>ATTGCGGCTCTCATGCGCTGTCTCCGGCTTCGCCCTGTCAAATCACGGGA<br>TGTCGTGGGTCAGACGGGCCCCGGGAAAGGGTCTGGAATGGGTGTCGGGG<br>ATTGTGTACAGCGGCTCCACCTACTACGCCGCTTCGGTCAAGGGCCGCTT<br>CACTATTTCACGGGACAACAGCCGCAACACCCTCTATCTGCAAATGAACT<br>CTCTCCGCCCGGAGGATACCGCCATCTACTACTGCTCCGCACACGGCGGC<br>GAATCCGACGTGTGGGGACAGGGAACCACTGTCACCGTGTCGTCCGCATC<br>CGGTGGCGGAGGATCGGGTGGCCGGGCCTCCGGGGGCGGCGGCAGCGAGA<br>CTACCCTGACCCAGTCCCCTGCCACTCTGTCCGTGAGCCCGGAGAGAGA<br>GCCACCCTTAGCTGCCGGGCCAGCCAGAGCGTGGGCTCCAACCTGGCCTG<br>GTACCAGCAGAAGCCAGGACAGGGTCCCAGGCTGCTGATCTACGGAGCCT<br>CCACTCGCGCGACCGGCATCCCCGCGAGGTTCTCCGGGTCGGGTTCCGGG<br>ACCGAGTTCACCCTGACCATCTCCTCCCTCCAACCGGAGGACTTCGCGGT<br>GTACTACTGTCAGCAGTACAACGATTGGCTGCCCGTGACATTTGGACAGG<br>GGACGAAGGTGGAAATCAAA |
| 139113-aa<br>VH | 7982 | EVQLVETGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSS |
| 139113-aa<br>VL | 7997 | ETTLTQSPATLSVSPGERATLSCRASQSVGSNLAWYQQKPGQGPRLLIYG<br>ASTRATGIPARESGSGSGTEFTLTISSLQPEDFAVYYCQQYNDWLPVTFG<br>QGTKVEIK |
| | | 139114 |
| 139114-aa<br>ScFv domain | 7953 | EVQLVESGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSSASGGGGSGGRASGGGGSEIVLTQSPGTLSLSPGER<br>ATLSCRASQSIGSSSLAWYQQKPGQAPRLLMYGASSRASGIPDRFSGSGS<br>GTDFTLTISRLEPEDFAVYYCQQYAGSPPFTFGQGTKVEIK |
| 139114-nt<br>ScFv domain | 7968 | GAAGTGCAATTGGTGGAATCTGGTGGAGGACTTGTGCAACCTGGAGGATC<br>ACTGAGACTGTCATGCGCGGTGTCCGGTTTTGCCCTGAGCAATCATGGGA<br>TGTCGTGGGTCCGGCGCGCCCCCGGAAAGGGTCTGGAATGGGTGTCGGGT<br>ATCGTCTACTCCGGGAGCACTTACTACGCCGCGAGCGTGAAGGGCCGCTT<br>CACCATTTCCCGCGATAACTCCCGCAACACCCTGTACTTGCAAATGAACT<br>CGCTCCGGCCTGAGGACACTGCCATCTACTACTGCTCCGCACACGGAGGA<br>GAATCCGACGTGTGGGGCCAGGGAACTACCGTGACCGTCAGCAGCGCCTC<br>CGGCGGCGGGGGCTCAGGCGGACGGGCTAGCGGCGGCGGTGGCTCCGAGA<br>TCGTGCTGACCCAGTCGCCTGGCACTCTCTCGCTGAGCCCCGGGGAAAGG<br>GCAACCCTGTCCTGTCGGGCCAGCCAGTCCATTGGATCATCCTCCCTCGC<br>CTGGTATCAGCAGAAACCGGGACAGGCTCCGCGGCTGCTTATGTATGGGG<br>CCAGCTCAAGAGCCTCCGGCATTCCCGACCGGTTCTCCGGGTCCGGTTCC<br>GGCACCGATTTCACCCTGACTATCTCGAGGCTGGAGCCAGAGGACTTCGC<br>CGTGTACTACTGCCAGCAGTACGCGGGGTCCCCGCCGTTCACGTTCGGAC<br>AGGGAACCAAGGTCGAGATCAAG |
| 139114-aa<br>VH | 7983 | EVQLVESGGGLVQPGGSLRLSCAVSGFALSNHGMSWVRRAPGKGLEWVSG<br>IVYSGSTYYAASVKGRFTISRDNSRNTLYLQMNSLRPEDTAIYYCSAHGG<br>ESDVWGQGTTVTVSS |
| 139114-aa<br>VL | 7998 | EIVLTQSPGTLSLSPGERATLSCRASQSIGSSSLAWYQQKPGQAPRLLMY<br>GASSRASGIPDRFSGSGSGTDFTLTISRLEPEDFAVYYCQQYAGSPPFTF<br>GQGTKVEIK |
| | | 149362 |
| 149362-aa<br>ScFv domain | 8029 | QVQLQESGPGLVKPSETLSLTCTVSGGSISSSYYYWGWIRQPPGKGLEWI<br>GSIYYSGSAYYNPSLKSRVTISVDTSKNQFSLRLSSVTAADTAVYYCARH<br>WQEWPDAFDIWGQGTMVTVSSGGGGSGGGGSGGGGSETTLTQSPAFMSAT<br>PGDKVIISCKASQDIDDAMNWYQQKPGEAPLFIIQSATSPVPGIPPRFSG<br>SGFGTDFSLTINNIESEDAAYYFCLQHDNFPLTFGQGTKLEIK |

TABLE 18-continued

Antigen Binding domains that bind BCMA
The amino acid sequences variable heavy chain and variable light chain
sequences for each scFv is also provided.

| Name/ Description | SEQ ID NO: | Sequence |
|---|---|---|
| 149362-nt ScFv domain | 8050 | CAAGTGCAGCTTCAGGAAAGCGGACCGGGCCTGGTCAAGCCATCCGAAAC TCTCTCCCTGACTTGCACTGTGTCTGGCGGTTCCATCTCATCGTCGTACT ACTACTGGGGCTGGATTAGGCAGCCGCCCGGAAAGGGACTGGAGTGGATC GGAAGCATCTACTATTCCGGCTCGGCTACTACAACCCTAGCCTCAAGTC GAGAGTGACCATCTCCGTGGATACCTCCAAGAACCAGTTTTCCCTGCGCC TGAGCTCCGTGACCGCCGCTGACACCGCCGTGTACTACTGTGCTCGGCAT TGGCAGGAATGGCCCGATGCCTTCGACATTTGGGGCCAGGGCACTATGGT CACTGTGTCATCCGGGGGTGGAGGCAGCGGGGGAGGAGGGTCCGGGGGGG GAGGTTCAGAGACAACCTTGACCCAGTCACCCGCATTCATGTCCGCCACT CCGGGAGACAAGGTCATCATCTCGTGCAAAGCGTCCCAGGATATCGACGA TGCCATGAATTGGTACCAGCAGAAGCCTGGCGAAGCGCCGCTGTTCATTA TCCAATCCGCAACCTCGCCCGTGCCTGGAATCCCACCGCGGTTCAGCGGC AGCGGTTTCGGAACCGACTTTTCCCTGACCATTAACAACATTGAGTCCGA GGACGCCGCCTACTACTTCTGCCTGCAACACGACAACTTCCCTCTCACGT TCGGCCAGGGAACCAAGCTGGAAATCAAG |
| 149362-aa VH | 8071 | QVQLQESGPGLVKPSETLSLTCTVSGGSISSSYYYWGWIRQPPGKGLEWI GSIYYSGSAYYNPSLKSRVTISVDTSKNQFSLRLSSVTAADTAVYYCARH WQEWPDAFDIWGQGTMVTVSS |
| 149362-aa VL | 8092 | ETTLTQSPAFMSATPGDKVIISCKASQDIDDAMNWYQQKPGEAPLFIIQS ATSPVPGIPPRFSGSGFGTDFSLTINNIESEDAAYYFCLQHDNFPLTFGQ GTKLEIK |

149363

| 149363-aa ScFv domain | 8030 | QVNLRESGPALVKPTQTLTLTCTFSGFSLRTSGMCVSWIRQPPGKALEWL ARIDWDEDKFYSTSLKTRLTISKDTSDNQVVLRMTNMDPADTATYYCARS GAGGTSATAFDIWGPGTMVTVSSGGGGSGGGGSGGGGSDIQMTQSPSSLS ASVGDRVTITCRASQDIYNNLAWFQLKPGSAPRSLMYAANKSQSGVPSRF SGSASGTDFTLTISSLQPEDFATYYCQHYYRFPYSFGQGTKLEIK |
| 149363-nt ScFv domain | 8051 | CAAGTCAATCTGCGCGAATCCGGCCCCGCCTTGGTCAAGCCTACCCAGAC CCTCACTCTGACCTGTACTTTCTCCGGCTTCTCCCTGCGGACTTCCGGGA TGTGCGTGTCCTGGATCAGACAGCCTCCGGGAAAGGCCCTGGAGTGGCTC GCTCGCATTGACTGGGATGAGGACAAGTTCTACTCCACCTCACTCAAGAC CAGGCTGACCATCAGCAAAGATACCTCTGACAACCAAGTGGTGCTCCGCA TGACCAACATGGACCCAGCCGACACTGCCACTTACTACTGCGCGAGGAGC GGAGCGGGCGGAACCTCCGCCACCGCCTTCGATATTTGGGGCCCGGGTAC CATGGTCACCGTGTCAAGCGGAGGAGGGGGGTCCGGGGGCGGCGGTTCCG GGGGAGGCGGATCGGACATTCAGATGACTCAGTCACCATCGTCCCTGAGC GCTAGCGTGGGCGACAGAGTGACAATCACTTGCCGGGCATCCCAGGACAT CTATAACAACCTTGCGTGGTTCCAGCTGAAGCCTGGTTCCGCACCGCGGT CACTTATGTACGCCGCCAACAAGAGCCAGTCGGGAGTGCCGTCCCGGTTT TCCGGTTCGGCCTCGGGAACTGACTTCACCCTGACGATCTCCAGCCTGCA ACCCGAGGATTTCGCCACCTACTACTGCCAGCACTACTACCGCTTTCCCT ACTCGTTCGGACAGGGAACCAAGCTGGAAATCAAG |
| 149363-aa VH | 8072 | QVNLRESGPALVKPTQTLTLTCTFSGFSLRTSGMCVSWIRQPPGKALEWL ARIDWDEDKFYSTSLKTRLTISKDTSDNQVVLRMTNMDPADTATYYCARS GAGGTSATAFDIWGPGTMVTVSS |
| 149363-aa VL | 8093 | DIQMTQSPSSLSASVGDRVTITCRASQDIYNNLAWFQLKPGSAPRSLMYA ANKSQSGVPSRFSGSASGTDFTLTISSLQPEDFATYYCQHYYRFPYSFGQ GTKLEIK |

149364

| 149364-aa ScFv domain | 8031 | EVQLVESGGGLVKPGGSLRLSCAASGFTFSSYSMNWVRQAPGKGLEWVSS ISSSSSYIYYADSVKGRFTISRDNAKNSLYLQMNSLRAEDTAVYYAKTI AAVYAFDIWGQGTTVTVSSGGGGSGGGGSGGGGSEIVLTQSPLSLPVTPE EPASISCRSSQSLLHSNGYNYLDWYLQKPGQSPQLLIYLGSNRASGVPDR FSGSGSGTDFTLKISRVEAEDVGVYYCMQALQTPYTFGQGTKLEIK |
| 149364-nt ScFv domain | 8052 | GAAGTGCAGCTTGTCGAATCCGGGGGGGACTGGTCAAGCCGGGCGGATC ACTGAGACTGTCCTGCGCCGCGAGCGGCTTCACGTTCTCCTCCTACTCCA TGAACTGGGTCCGCCAAGCCCCGGGAAGGGACTGGAATGGGTGTCCTCT ATCTCCTCGTCGTCGTCCTACATCTACTACGCCGACTCCGTGAAGGGAAG ATTCACCATTTCCCGCGACAACGCAAAGAACTCACTGTACTTGCAAATGA ACTCACTCCGGGCCGAAGATACTGCTGTGTACTATTGCGCCAAGACTATT GCCGCCGTCTACGCTTTCGACATCTGGGGCCAGGGAACCACCGTGACTGT GTCGTCCGGTGGTGGTGGCTCGGGCGGAGGAGGAAGCGGCGGCGGGGGT CCGAGATTGTGCTGACCCAGTCGCCACTGAGCCTTCCCTGTGACCCCCGAG |

TABLE 18-continued

Antigen Binding domains that bind BCMA
The amino acid sequences variable heavy chain and variable light chain
sequences for each scFv is also provided.

| Name/ Description | SEQ ID NO: | Sequence |
|---|---|---|
| | | GAACCCGCCAGCATCAGCTGCCGGTCCAGCCAGTCCCTGCTCCACTCCAA CGGATACAATTACCTCGATTGGTACCTTCAGAAGCCTGGACAAAGCCCGC AGCTGCTCATCTACTTGGGATCAAACCGCGCGTCAGGAGTGCCTGACCGG TTCTCCGGCTCGGGCAGCGGTACCGATTTCACCCTGAAAATCTCCAGGGT GGAGGCAGAGGACGTGGGAGTGTATTACTGTATGCAGGCGCTGCAGACTC CGTACACATTTGGGCAGGGCACCAAGCTGGAGATCAAG |
| 149364-aa VH | 8073 | EVQLVESGGGLVKPGGSLRLSCAASGFTFSSYSMNWVRQAPGKGLEWVSS ISSSSSYIYYADSVKGRFTISRDNAKNSLYLQMNSLRAEDTAVYYCAKTI AAVYAFDIWGQGTTVTVSS |
| 149364-aa VL | 8094 | EIVLTQSPLSLPVTPEEPASISCRSSQSLLHSNGYNYLDWYLQKPGQSPQ LLIYLGSNRASGVPDRFSGSGSGTDFTLKISRVEAEDVGVYYCMQALQTP YTFGQGTKLEIK |
| | 149365 | |
| 149365-aa ScFv domain | 8032 | EVQLVESGGGLVKPGGSLRLSCAASGFTFSDYYMSWIRQAPGKGLEWVSY ISSSGSTIYYADSVKGRFTISRDNAKNSLYLQMNSLRAEDTAVYYCARDL RGAFDIWGQGTMVTVSSGGGGSGGGGSGGGGSSYVLTQSPSVSAAPGYTA TISCGGNNIGTKSVHWYQQKPGQAPLLVIRDDSVRPSKIPGRFSGSNSGN MATLTISGVQAGDEADFYCQVWDSDSEHVVFGGGTKLTVL |
| 149365-nt ScFv domain | 8053 | GAAGTCCAGCTCGTGGAGTCCGGCGGAGGCCTTGTGAAGCCTGGAGGTTC GCTGAGACTGTCCTGCGCCGCCTCCGGCTTCACCTTCTCCGACTACTACA TGTCCTGGATCAGACAGGCCCCGGGAAAGGGCCTGGAATGGGTGTCCTAC ATCTCGTCATCGGGCAGCACTATCTACTACGCGGACTCAGTGAAGGGGCG GTTCACCATTTCCCGGGATAACGCGAAGAACTCGCTGTATCTGCAAATGA ACTCACTGAGGGCCGAGGACACCGCCGTGTACTACTGCGCCCGCGATCTC CGCGGGGCATTTGACATCTGGGGACAGGGAACCATGGTCACAGTGTCCAG CGGAGGGGGAGGATCGGGTGGCGGAGGTTCCGGGGGTGGAGGCTCCTCCT ACGTGCTGACTCAGAGCCCAAGCGTCAGCGCTGCGCCCGGTTACACGGCA ACCATCTCCTGTGGCGGAAACAACATTGGGACCAAGTCTGTGCACTGGTA TCAGCAGAAGCCGGGCCAAGCTCCCCTGTTGGTGATCCGCGATGACTCCG TGCGGCCTAGCAAAATTCCGGGACGGTTCTCCGGCTCCAACAGCGGCAAT ATGGCCACTCTCACCATCTCGGGAGTGCAGGCCGGAGATGAAGCCGACTT CTACTGCCAAGTCTGGGACTCAGACTCCGAGCATGTGGTGTTCGGGGGCG GAACCAAGCTGACTGTGCTC |
| 149365-aa VH | 8074 | EVQLVESGGGLVKPGGSLRLSCAASGFTFSDYYMSWIRQAPGKGLEWVSY ISSSGSTIYYADSVKGRFTISRDNAKNSLYLQMNSLRAEDTAVYYCARDL RGAFDIWGQGTMVTVSS |
| 149365-aa VL | 8095 | SYVLTQSPSVSAAPGYTATISCGGNNTGTKSVHWYQQKPGQAPLLVIRDD SVRPSKIPGRFSGSNSGNMATLTISGVQAGDEADFYCQVWDSDSEHVVFG GGTKLTVL |
| | 149366 | |
| 149366-aa ScFv domain | 8033 | QVQLVQSGAEVKKPGASVKVSCKPSGYTVTSHYIHWVRRAPGQGLEWMGM INPSGGVTAYSQTLQGRVTMTSDTSSSTVYMELSSLRSEDTAMYYCAREG SGSGWYFDFWGRGTLVTVSSGGGGSGGGGSGGGGSSYVLTQPPSVSVSPG QTASITCSGDGLSKKYVSWYQQKAGQSPVVLISRDKERPSGIPDRFSGSN SADTATLTISGTQAMDEADYYCQAWDDTTVVFGGGTKLTVL |
| 149366-nt ScFv domain | 8054 | CAAGTGCAGCTGGTGCAGAGCGGGGCCGAAGTCAAGAAGCCGGGAGCCTC CGTGAAAGTGTCCTGCAAGCCTTCGGGATACACCGTGACCTCCCACTACA TTCATTGGGTCCGCCGCGCCCCCGGCCAAGGACTCGAGTGGATGGGCATG ATCAACCCTAGCGGCGGAGTGACCGCGTACAGCCAGACGCTGCAGGGACG CGTGACTATGACCTCGGATACCTCCTCCTCCACCGTCTATATGGAACTGT CCAGCCTGCGGTCCGAGGATACCGCCATGTACTACTGCGCCCGGGAAGGA TCAGGCTCCGGGTGGTATTTCGACTTCTGGGGAAGAGGCACCCTCGTGAC TGTGTCATCTGGGGAGGGGGTTCCGGTGGTGGCGGATCGGGAGGAGGCG GTTCATCCTACGTGCTGACCCAGCCACCCTCCGTGTCCGTGAGCCCCGGC CAGACTGCATCGATTACATGTAGCGGCGACGGCCTCTCCAAGAAATACGT GTCGTGGTACCAGCAGAAGGCCGGACAGAGCCCGGTGGTGCTGATCTCAA GAGATAAGGAGCGGCCTAGCGGAATCCCGGACAGGTTCTCGGGTTCCAAC TCCGCGGACACTGCTACTCTGACCATCTCGGGGACCCAGGCTATGGACGA AGCCGATTACTACTGCCAAGCCTGGGACGACACTACTGTCGTGTTTGGAG GGGGCACCAAGTTGACCGTCCTT |

TABLE 18-continued

Antigen Binding domains that bind BCMA
The amino acid sequences variable heavy chain and variable light chain
sequences for each scFv is also provided.

| Name/<br>Description | SEQ ID<br>NO: | Sequence |
|---|---|---|
| 149366-aa VH | 8075 | QVQLVQSGAEVKKPGASVKVSCKPSGYTVTSHYIHWVRRAPGQGLEWMGM<br>INPSGGVTAYSQTLQGRVTMTSDTSSSTVYMELSSLRSEDTAMYYCAREG<br>SGSGWYFDFWGRGTLVTVSS |
| 149366-aa VL | 8096 | SYVLTQPPSVSVSPGQTASITCSGDGLSKKYVSWYQQKAGQSPVVLISRD<br>KERPSGIPDRFSGSNSADTATLTISGTQAMDEADYYCQAWDDTTVVFGGG<br>TKLTVL |

149367

| 149367-aa<br>ScFv domain | 8034 | QVQLQESGPGLVKPSQTLSLTCTVSGGSISSGGYYWSWIRQHPGKGLEWI<br>GYIYYSGSTYYNPSLKSRVTISVDTSKNQFSLKLSSVTAADTAVYYCARA<br>GIAARLRGAFDIWGQGTMVTVSSGGGGSGGGGSGGGGSDIVMTQSPSSVS<br>ASVGDRVIITCRASQGIRNWLAWYQQKPGKAPNLLIYAASNLQSGVPSRF<br>SGSGSGADFTLTISSLQPEDVATYYCQKYNSAPFTFGPGTKVDIK |
| 149367-nt<br>ScFv domain | 8055 | CAAGTGCAGCTTCAGGAGAGCGGCCCGGGACTCGTGAAGCCGTCCCAGAC<br>CCTGTCCCTGACTTGCACCGTGTCGGAGGAAGCATCTCGAGCGGAGGCT<br>ACTATTGGTCGTGGATTCGGCAGCACCCTGGAAAGGGCCTGGAATGGATC<br>GGCTACATCTACTACTCCGGCTCGACCTACTACAACCCATCGCTGAAGTC<br>CAGAGTGACAATCTCAGTGGACACGTCCAAGAATCAGTTCAGCCTGAAGC<br>TCTCTTCCGTGACTGCGGCCGACACCGCCGTGTACTACTGCGCACGCGCT<br>GGAATTGCCGCCCGGCTGAGGGGTGCCTTCGACATTTGGGGACAGGGCAC<br>CATGGTCACCGTGTCCTCCGGCGGCGGAGGTTCCGGGGGTGGAGGCTCAG<br>GAGGAGGGGGGTCCGACATCGTCATGACTCAGTCGCCCTCAAGCGTCAGC<br>GCGTCCGTCGGGGACAGAGTGATCATCACCTGTCGGGCGTCCCAGGGAAT<br>TCGCAACTGGCTGGCCTGGTATCAGCAGAAGCCCGGAAAGGCCCCCAACC<br>TGTTGATCTACGCCGCCTCAAACCTCCAATCCGGGGTGCCGAGCCGCTTC<br>AGCGGCTCCGGTTCGGGTGCCGATTTCACTCTGACCATCTCCTCCCTGCA<br>ACCTGAAGATGTGGCTACCTACTACTGCCAAAAGTACAACTCCGCACCTT<br>TTACTTTCGGACCGGGGACCAAAGTGGACATTAAG |
| 149367-aa VH | 8076 | QVQLQESGPGLVKPSQTLSLTCTVSGGSISSGGYYWSWIRQHPGKGLEWI<br>GYIYYSGSTYYNPSLKSRVTISVDTSKNQFSLKLSSVTAADTAVYYCARA<br>GIAARLRGAFDIWGQGTMVTVSS |
| 149367-aa VL | 8097 | DIVMTQSPSSVSASVGDRVIITCHASQGTHNWLAWYQQKPGKAPNLLIYA<br>ASNLQSGVPSRFSGSGSGADFTLTISSLQPEDVATYYCQKYNSAPFTFGP<br>GTKVDIK |

149368

| 149368-aa<br>ScFv domain | 8035 | QVQLVQSGAEVKKPGSSVKVSCKASGGTFSSYAISWVRQAPGQGLEWMGG<br>IIPIFGTANYAQKFQGRVTITADESTSTAYMELSSLRSEDTAVYYCARRG<br>GYQLLRWDVGLLRSAFDIWGQGTMVTVSSGGGGSGGGGSGGGGSSYVLTQ<br>PPSVSVAPGQTARITCGGNNIGSKSVHWYQQKPGQAPVLVLYGKNNRPSG<br>VPDRFSGSRSGTTASLTITGAQAEDEADYYCSSRDSSGDHLRVFGTGTKV<br>TVL |
| 149368-nt<br>ScFv domain | 8056 | CAAGTGCAGCTGGTCCAGTCGGGCGCCGAGGTCAAGAAGCCCGGGAGCTC<br>TGTGAAAGTGTCCTGCAAGGCCTCCGGGGGCACCTTTAGCTCCTACGCCA<br>TCTCCTGGGTCCGCCAAGCACCGGGTCAAGGCCTGGAGTGGATGGGGGGA<br>ATTATCCCTATCTTCGGCACTGCCAACTACGCCCAGAAGTTCCAGGGACG<br>CGTGACCATTACCGCGGACGAATCCACCTCCACCGCTTATATGGAGCTGT<br>CCAGCTTGCGCTCGGAAGATACCGCCGTGTACTACTGCGCCCGGAGGGGT<br>GGATACCAGCTGCTGAGATGGGACGTGGGCCTCCTGCGGTCGGCGTTCGA<br>CATCTGGGGCCAGGGCACTATGGTCACTGTGTCCAGCGGAGGAGGCGGAT<br>CGGGAGGCGGCGGATCAGGGGGAGGCGGTTCCAGCTACGTGCTTACTCAA<br>CCCCCTTCGGTGTCCGTGGCCCCGGGACAGACCGCCAGAATCACTTGCGG<br>AGGAAACAACATTGGGTCCAAGAGCGTGCATTGGTACCAGCAGAAGCCAG<br>GACAGGCCCCTGTGCTGGTGCTCTACGGGAAGAACAATCGGCCCAGCGGA<br>GTGCCGGACAGGTTCTCGGGTTCACGCTCCGGTACAACCGCTTCACTGAC<br>TATCACCGGGGCCCAGGCAGAGGATGAAGCGGACTACTACTGTTCCTCCC<br>GGGATTCATCCGGCGACCACCTCCGGGTGTTCGGAACCGGAACGAAGGTC<br>ACCGTGCTG |
| 149368-aa VH | 8077 | QVQLVQSGAEVKKPGSSVKVSCKASGGTFSSYAISWVRQAPGQGLEWMGG<br>IIPIFGTANYAQKFQGRVTITADESTSTAYMELSSLRSEDTAVYYCARRG<br>GYQLLRWDVGLLRSAFDIWGQGTMVTVSS |

TABLE 18-continued

Antigen Binding domains that bind BCMA
The amino acid sequences variable heavy chain and variable light chain
sequences for each scFv is also provided.

| Name/ Description | SEQ ID NO: | Sequence |
|---|---|---|
| 149368-aa VL | 8098 | SYVLTQPPSVSVAPGQTARITCGGNNIGSKSVHWYQQKPGQAPVLVLYGK NNRPSGVPDRFSGSRSGTTASLTITGAQAEDEADYYCSSRDSSGDHLRVF GTGTKVTVL |
| 149369 | | |
| 149369-aa ScFv domain | 8036 | EVQLQQSGPGLVKPSQTLSLTCAISGDSVSSNSAAWNWIRQSPSRGLEWL GRTYYRSKWYSFYAISLKSRIIINPDTSKNQFSLQLKSVTPEDTAVYYCA RSSPEGLFLYWFDPWGQGTLVTVSSGGDGSGGGGSGGGGSSSELTQDPAV SVALGQTIRITCQGDSLGNYYATWYQQKPGQAPVLVIYGTNNRPSGIPDR FSASSSGNTASLTITGAQAEDEADYYCNSRDSSGHHLLFGTGTKVTVL |
| 149369-nt ScFv domain | 8057 | GAAGTGCAGCTCCAACAGTCAGGACCGGGGCTCGTGAAGCCATCCCAGAC CCTGTCCCTGACTTGTGCCATCTCGGGAGATAGCGTGTCATCGAACTCCG CCGCCTGGAACTGGATTCGGCAGAGCCCGTCCCGCGGACTGGAGTGGCTT GGAAGGACCTACTACCGGTCCAAGTGGTACTCTTTCTACGCGATCTCGCT GAAGTCCCGCATTATCATTAACCCTGATACCTCCAAGAATCAGTTCTCCC TCCAACTGAAATCCGTCACCCCCGAGGACACAGCAGTGTATTACTGCGCA CGGAGCAGCCCCGAAGGACTGTTCCTGTATTGGTTTGACCCCTGGGGCCA GGGGACTCTTGTGACCGTGTCGAGCGGCGGAGATGGGTCCGGTGGCGGTG GTTCGGGGGGCGGCGGATCATCATCCGAACTGACCCAGGACCCGGCTGTG TCCGTGGCGCTGGGACAAACCATCCGCATTACGTGCCAGGGAGACTCCCT GGGCAACTACTACGCCACTTGGTACCAGCAGAAGCCGGGCCAAGCCCCTG TGTTGGTCATCTACGGGACCAACAACAGACCTTCCGGCATCCCCGACCGG TTCAGCGCTTCGTCCTCCGGCAACACTGCCAGCCTGACCATCACTGGAGC GCAGGCCGAAGATGAGGCCGACTACTACTGCAACAGCAGAGACTCCTCGG GTCATCACCTCTTGTTCGGAACTGGAACCAAGGTCACCGTGCTG |
| 149369-aa VH | 8078 | EVQLQQSGPGLVKPSQTLSLTCAISGDSVSSNSAAWNWIRQSPSRGLEWL GRTYYRSKWYSFYAISLKSRIIINPDTSKNQFSLQLKSVTPEDTAVYYCA RSSPEGLFLYWFDPWGQGTLVTVSS |
| 149369-aa VL | 8099 | SSELTQDPAVSVALGQTIRITCQGDSLGNYYATWYQQKPGQAPVLVIYGT NNRPSGIPDRFSASSSGNTASLTITGAQAEDEADYYCNSRDSSGHHLLFG TGTKVTVL |
| BCMA_EBB-C1978-A4 | | |
| BCMA_EBB-C1978-A4-aa ScFv domain | 8037 | EVQLVESGGGLVQPGGSLRLSCAASGFTFSSYAMSWVRQAPGKGLEWVSA ISGSGGSTYYADSVKGRFTISRDNSKNTLYLQMNSLRAEDTAVYYCAKVE GSGSLDYWGQGTLVTVSSGGGGSGGGGSGGGGSEIVMTQSPGTLSLSPGE RATLSCRASQSVSSAYLAWYQQKPGQPPRLLISGASTRATGIPDRFGGSG SGTDFTLTISRLEPEDFAVYYCQHYGSSENGSSLFTEGQGTRLEIK |
| BCMA_EBB-C1978-A4-nt ScFv domain | 8058 | GAAGTGCAGCTCGTGGAGTCAGGAGGCGGCCTGGTCCAGCCGGGAGGGTC CCTTAGACTGTCATGCGCCGCAAGCGGATTCACTTTCTCCTCCTATGCCA TGAGCTGGGTCCGCCAAGCCCCCGGAAAGGGACTGGAATGGGTGTCCGCC ATCTCGGGGTCTGGAGGCTCAACTTACTACGCTGACTCCGTGAAGGGACG GTTCACCATTAGCCGCGACAACTCCAAGAACACCCTCTACCTCCAAATGA ACTCCCTGCGGGCCGAGGATACCGCCGTCTACTACTGCGCCAAAGTGGAA GGTTCAGGATCGCTGGACTACTGGGGACAGGGTACTCTCGTGACCGTGTC ATCGGGCGGAGGAGGTTCCGGCGGTGGCGGCTCCGGCGGCGGAGGGTCGG AGATCGTGATGACCCAGAGCCCTGGTACTCTGAGCCTTTCGCCGGGAGAA AGGGCCACCCTGTCCTGCCGCGCTTCCCAATCCGTGTCCTCCGCGTACTT GGCGTGGTACCAGCAGAAGCCGGGACAGCCCCTCGGCTGCTGATCAGCGG GGGCCAGCACCCGGGCAACCGGAATCCCAGACAGATTCGGGGGTTCCGGC AGCGGCACAGATTTCACCCTGACTATTTCGAGGTTGGAGCCCGAGGACTT TGCGGTGTATTACTGTCAGCACTACGGGTCGTCCTTTAATGGCTCCAGCC TGTTCACGTTCGGACAGGGGACCCGCCTGGAAATCAAG |
| BCMA_EBB-C1978-A4-aa VH | 8079 | EVQLVESGGGLVQPGGSLRLSCAASGFTFSSYAMSWVRQAPGKGLEWVSA ISGSGGSTYYADSVKGRFTISRDNSKNTLYLQMNSLRAEDTAVYYCAKVE GSGSLDYWGQGTLVTVSS |
| BCMA_EBB-C1978-A4-aa VL | 8100 | EIVMTQSPGTLSLSPGERATLSCRASQSYSSAYLAWYQQKPGQPPRLLIS GASTRATGIPDRFGGSGSGTDFTLTISRLEPEDFAVYYCQHYGSSFNGSS LFTFGQGTRLEIK |
| BCMA_EBB-C1978-G1 | | |
| BCMA_EBB-C1978-G1-aa | 8038 | EVQLVETGGGLVQPGGSLRLSCAASGITFSRYPMSWVRQAPGKGLEWVSG ISDSGVSTYYADSAKGRFTISRDNSKNTLFLQMSSLRDEDTAVYYCVTRA |

TABLE 18-continued

Antigen Binding domains that bind BCMA
The amino acid sequences variable heavy chain and variable light chain sequences for each scFv is also provided.

| Name/ Description | SEQ ID NO: | Sequence |
| --- | --- | --- |
| ScFv domain | | GSEASDIWGQGTMVTVSSGGGGSGGGGSGGGGSEIVLTQSPATLSLSPGE RATLSCRASQSVSNSLAWYQQKPGQAPRLLIYDASSRATGIPDRFSGSGS GTDFTLTISRLEPEDFAIYYCQQFGTSSGLTFGGGTKLEIK |
| BCMA_EBB-C1978-G1-nt ScFv domain | 8059 | GAAGTGCAACTGGTGGAAACCGGTGGCGGCCTGGTGCAGCCTGGAGGATC ATTGAGGCTGTCATGCGCGGCCAGCGGTATTACCTTCTCCCGGTACCCCA TGTCCTGGGTCAGACAGGCCCCGGGGAAAGGGCTTGAATGGGTGTCCGGG ATCTCGGACTCCGGTGTCAGCACTTACTACGCCGACTCCGCCAAGGGACG CTTCACCATTTCCCGGGACAACTCGAAGAACACCCTGTTCCTCCAAATGA GCTCCCTCCGGGACGAGGATACTGCAGTGTACTACTGCGTGACCCGCGCC GGGTCCGAGGCGTCTGACATTTGGGGACAGGGCACTATGGTCACCGTGTC GTCCGGCGGAGGGGGCTCGGGAGGCGGTGGCAGCGGAGGAGGAGGGTCCG AGATCGTGCTGACCCAATCCCCGGCCACCCTCTCGCTGAGCCCTGGAGAA AGGGCAACCTTGTCCTGTCGCGCGAGCCAGTCCGTGAGCAACTCCCTGGC CTGGTACCAGCAGAAGCCCGGACAGGCTCCGAGACTTCTGATCTACGACG CTTCGAGCCGGGCCACTGGAATCCCCGACCGCTTTTCGGGGTCCGGCTCA GGAACCGATTTCACCCTGACAATCTCACGGCTGGAGCCAGAGGATTTCGC CATCTATTACTGCCAGCAGTTCGGTACTTCCTCCGGCCTGACTTTCGGAG GCGGCACGAAGCTCGAAATCAAG |
| BCMA_EBB-C1978-G1-aa VH | 8080 | EVQLVETGGGLVQPGGSLRLSCAASGITFSRYPMSWVRQAPGKGLEWVSG ISDSGVSTYYADSAKGRFTISRDNSKNTLFLQMSSLRDEDTAVYYCVTRA GSEASDIWGQGTMVTVSS |
| BCMA_EBB-C1978-G1-aa VL | 8101 | EIVLTQSPATLSLSPGERATLSCRASQSYSNSLAWYQQKPGQAPRLLIYD ASSRATGIPDRFSGSGSGTDFTLTISRLEPEDFAIYYCQQFGTSSGLTFG GGTKLEIK |
| BCMA_EBB-C1979-C1 | | |
| BCMA_EBB-C1979-C1-aa ScFv domain | 8039 | QVQLVESGGGLVQPGGSLRLSCAASGFTFSSYAMSWVRQAPGKGLEWVSA ISGSGGSTYYADSVKGRFTISRDNAKNSLYLQMNSLRAEDTAIYYCARAT YKRELRYYYGMDVWGQGTMVTVSSGGGGSGGGGSGGGGSEIVMTQSPGTV SLSPGERATLSCRASQSVSSSFLAWYQQKPGQAPRLLIYGASSRATGIPD RFSGSGSGTDFTLTISRLEPEDSAVYYCQQYHSSPSWTFGQGTRLEIK |
| BCMA_EBB-C1979-C1-nt ScFv domain | 8060 | CAAGTGCAGCTCGTGGAATCGGTGGCGGACTGGTGCAGCCGGGGGGCTC ACTTAGACTGTCCTGCGCGGCCAGCGGATTCACTTTCTCCTCCTACGCCA TGTCCTGGGTCAGACAGGCCCCTGGAAAGGGCCTGGAATGGGTCCGCA ATCAGCGGCAGCGGCGGCTCGACCTATTACGCGGATTCAGTGAAGGGCAG ATTCACCATTTCCCGGGACAACGCCAAGAACTCCTTGTACCTTCAAATGA ACTCCCTCCGCGCGGAAGATACCGCAATCTACTACTGCGCTCGGGCCACT TACAAGAGGGAACTGCGCTACTACTACGGGATGGACGTCTGGGGCCAGGG AACCATGGTCACCGTGTCCAGCGGAGGAGGAGGATCGGGAGGAGGCGGTA GCGGGGGTGGAGGGTCGGAGATCGTGATGACCCAGTCCCCCGGCACTGTG TCGCTGTCCCCGGCGAACGGGCCACCCTGTCATGTCGGGCCAGCCAGTC AGTGTCGTCAAGCTTCCTCGCCTGGTACCAGCAGAAACCGGGACAAGCTC CCCGCCTGCTGATCTACGGAGCCAGCAGCCGGGCCACCGGTATTCCTGAC CGGTTCTCCGGTTCGGGTCCGGGACCGACTTTACTCTGACTATCTCTCG CCTCGAGCCAGAGGACTCCGCCGTGTATTACTGCCAGCAGTACCACTCCT CCCCGTCCTGGACGTTCGGACAGGGCACAAGGCTGGAGATTAAG |
| BCMA_EBB-C1979-C1-aa VH | 8081 | QVQLVESGGGLVQPGGSLRLSCAASGFTFSSYAMSWVRQAPGKGLEWVSA ISGSGGSTYYADSVKGRFTISRDNAKNSLYLQMNSLRAEDTAIYYCARAT YKRELRYYYGMDVWGQGTMVTVSS |
| BCMA_EBB-C1979-C1-aa VL | 8102 | EIVMTQSPGTVSLSPGERATLSCRASQSYSSSFLAWYQQKPGQAPRLLIY GASSRATGIPDRFSGSGSGTDFTLTISRLEPEDSAVYYCQQYHSSPSWTF GQGTRLEIK |
| BCMA_EBB-C1978-C7 | | |
| BCMA_EBB-C1978-C7-aa ScFv domain | 8040 | EVQLVETGGGLVQPGGSLRLSCAASGFTFSSYAMSWVRQAPGKGLEWVSA ISGSGGSTYYADSVKGRFTISRDNSKNTLYLQMNTLKAEDTAVYYCARAT YKRELRYYYGMDVWGQGTTVTVSSGGGGSGGGGSGGGGSEIVLTQSPSTL SLSPGESATLSCRASQSVSTTFLAWYQQKPGQAPRLLIYGSSNRATGIPD RFSGSGSGTDFTLTIRRLEPEDFAVYYCQQYHSSPSWTFGQGTKVEIK |
| BCMA_EBB-C1978-C7-nt ScFv domain | 8061 | GAGGTGCAGCTTGTGGAAACCGGTGGCGGACTGGTGCAGCCCGGAGGAAG CCTCAGGCTGTCCTGCGCCGCGTCCGGCTTCACCTTCTCCTCGTACGCCA TGTCCTGGGTCCGCCAGGCCCCCGAAAGGGCCTGGAATGGGTGTCCGCC ATCTCTGGAAGCGGAGGTTCCACGTACTACGCGGACAGCGTCAAGGGAAG GTTCACAATCTCCCGCGATAATTCGAAGAACACTCTGTACCTTCAAATGA |

TABLE 18-continued

Antigen Binding domains that bind BCMA
The amino acid sequences variable heavy chain and variable light chain
sequences for each scFv is also provided.

| Name/<br>Description | SEQ ID<br>NO: | Sequence |
|---|---|---|
| | | ACACCCTGAAGGCCGAGGACACTGCTGTGTACTACTGCGCACGGGCCACC<br>TACAAGAGAGAGCTCCGGTACTACTACGGAATGGACGTCTGGGGCCAGGG<br>AACTACTGTGACCGTGTCCTCGGGAGGGGTGGCTCCGGGGGGGCGGCT<br>CCGGCGGAGGCGGTTCCGAGATTGTGCTGACCCAGTCACCTTCAACTCTG<br>TCGCTGTCCCCGGGAGAGAGCGCTACTCTGAGCTGCCGGGCCAGCCAGTC<br>CGTGTCCACCACCTTCCTCGCCTGGTATCAGCAGAAGCCGGGCAGGCAC<br>CACGGCTCTTGATCTACGGGTCAAGCAACAGAGCGACCGGAATTCCTGAC<br>CGCTTCTCGGGGAGCGGTTCAGGCACCGACTTCACCCTGACTATCCGGCG<br>CCTGGAACCCGAAGATTTCGCCGTGTATTACTGTCAACAGTACCACTCCT<br>CGCCGTCCTGGACCTTTGGCCAAGGAACCAAAGTGGAAATCAAG |
| BCMA_EBB-<br>C1978-C7-aa<br>VH | 8082 | EVQLVETGGGLVQPGGSLRLSCAASGFTFSSYAMSWVRQAPGKGLEWVSA<br>ISGSGGSTYYADSVKGRFTISRDNSKNTLYLQMNTLKAEDTAVYYCARAT<br>YKRELRYYYGMDVWGQGTTVTVSS |
| BCMA_EBB-<br>C1978-C7-aa<br>VL | 8103 | EIVLTQSPSTLSLSPGESATLSCRASQSYSTTFLAWYQQKPGQAPRLLIY<br>GSSNRATGIPDRFSGSGSGTDFTLTIRRLEPEDFAVYYCQQYHSSPSWTF<br>GQGTKVEIK |
| BCMA_EBB-C1978-D10 | | |
| BCMA_EBB-<br>C1978-D10-<br>aa<br>ScFv domain | 8041 | EVQLVETGGGLVQPGRSLRLSCAASGFTFDDYAMHWVRQAPGKGLEWVSG<br>ISWNSGSIGYADSVKGRFTISRDNAKNSLYLQMNSLRDEDTAVYYCARVG<br>KAVPDVWGQGTTVTVSSGGGGSGGGGSGGGGSDIVMTQTPSSLSASVGDR<br>VTITCRASQSISSYLNWYQQKPGKAPKLLIYAASSLQSGVPSRFSGSGSG<br>TDFTLTISSLQPEDFATYYCQQSYSTPYSFGQGTRLEIK |
| BCMA_EBB-<br>C1978-D10-nt<br>ScFv domain | 8062 | GAAGTGCAGCTCGTGGAAACTGGAGGTGGACTCGTGCAGCCTGGACGGTC<br>GCTGCGGCTGAGCTGCGCTGCATCCGGCTTCACCTTCGACGATTATGCCA<br>TGCACTGGGTCAGACAGGCGCCAGGGAAGGGACTTGAGTGGGTGTCCGGT<br>ATCAGCTGGAATAGCGGCTCAATCGGATACGCGGACTCCGTGAAGGGAAG<br>GTTCACCATTTCCCGCGACAACGCCAAGAACTCCCTGTACTTGCAAATGA<br>ACAGCCTCCGGGATGAGGACACTGCCGTGTACTACTGCGCCCGCGTCGGA<br>AAAGCTGTGCCCGACGTCTGGGGCCAGGGAACCACTGTGACCGTGTCCAG<br>CGGCGGGGTGGATCGGCGGTGGAGGGTCCGGTGGAGGGGGCTCAGATA<br>TTGTGATGACCCAGACCCCCTCGTCCCTGTCCGCCTCGGTCGGCGACCGC<br>GTGACTATCACATGTAGAGCCTCGCAGAGCATCTCCAGCTACCTGAACTG<br>GTATCAGCAGAAGCCGGGAAGGCCCCGAAGCTCCTGATCTACGCGGCAT<br>CATCACTGCAATCGGGAGTGCCGAGCCGGTTTTCCGGGTCCGGCTCCGGC<br>ACCGACTTCACGCTGACCATTTCTTCCCTGCAACCCGAGGACTTCGCCAC<br>TTACTACTGCCAGCAGTCCTACTCCACCCCTTACTCCTTCGGCCAAGGAA<br>CCAGGCTGGAAATCAAG |
| BCMA_EBB-<br>C1978-D10-<br>aa<br>VH | 8083 | EVQLVETGGGLVQPGRSLRLSCAASGFTFDDYAMHWVRQAPGKGLEWVSG<br>ISWNSGSIGYADSVKGRFTISRDNAKNSLYLQMNSLRDEDTAVYYCARVG<br>KAVPDVWGQGTTVTVSS |
| BCMA_EBB-<br>C1978-D10-aa<br>VL | 8104 | DIVMTQTPSSLSASVGDRVTITCRASQSISSYLNWYQQKPGKAPKLLIYA<br>ASSLQSGVPSRFSGSGSGTDFTLTISSLQPEDFATYYCQQSYSTPYSFGQ<br>GTRLEIK |
| BCMA_EBB-C1979-C12 | | |
| BCMA_EBB-<br>C1979-C12-aa<br>ScFv domain | 8042 | EVQLVESGGGLVQPGRSLRLSCTASGFTFDDYAMHWVRQRPGKGLEWVAS<br>INWKGNSLAYGDSVKGRFAISRDNAKNTVFLQMNSLRTEDTAVYYCASHQ<br>GVAYYNYAMDVWGRGTLVTVSSGGGGSGGGGSGGGGSEIVLTQSPGTLSL<br>SPGERATLSCRATQSIGSSFLAWYQQRPGQAPRLLIYGASQRATGIPDRF<br>SGRGSGTDFTLTISRVEPEDSAVYYCQHYESSPSWTFGQGTKVEIK |
| BCMA_EBB-<br>C1979-C12-nt<br>ScFv domain | 8063 | GAAGTGCAGCTCGTGGAGAGCGGGGAGGATTGGTGCAGCCCGGAAGGTC<br>CCTGCGGCTCTCCTGCACTGCGTCGGCTTCACCTTCGACGACTACGCGA<br>TGCACTGGGTCAGACAGCGCCCGGGAAAGGGCCTGGAATGGGTCGCCTCA<br>ATCAACTGGAAGGGAAATCCCTGGCCTATGGCGACAGCGTGAAGGGCCG<br>CTTCGCCATTTCGCGCGACAACGCCAAGAACACCGTGTTTCTGCAAATGA<br>ATTCCCTGCGGACCGAGGATACCGCTGTGTACTACTGCGCCAGCCACCAG<br>GGCGTGGCATACTATAACTACGCCATGGACGTGTGGGGAAGAGGGACGCT<br>CGTCACCGTGTCCTCCGGGGGCGGTGGATCGGGTGGTGAGGGGGAAGCGGTG<br>GCGGGGGCAGCGAAATCGTGCTGACTCAGAGCCCGGGAACTCTTTCACTG<br>TCCCGGGAGAACGGGCCACTCTCTCGTGCCGGGCCACCCAGTCCATCGG<br>CTCCTCCTTCCTTGCCTGGTACCAGCAGAGGCCAGGACAGGCGCCCCGCC<br>TGCTGATCTACGGTGCTTCCCAACGCGCCACTGGCATTCCTGACCGGTTC<br>AGCGGCAGAGGGTCGGGAACCGATTTCACACTGACCATTTCCCGGGTGGA |

TABLE 18-continued

Antigen Binding domains that bind BCMA
The amino acid sequences variable heavy chain and variable light chain
sequences for each scFv is also provided.

| Name/Description | SEQ ID NO: | Sequence |
|---|---|---|
| | | GCCCGAAGATTCGGCAGTCTACTACTGTCAGCATTACGAGTCCTCCCCTT<br>CATGGACCTTCGGTCAAGGGACCAAAGTGGAGATCAAG |
| BCMA_EBB-C1979-C12-aa VH | 8084 | EVQLVESGGGLVQPGRSLRLSCTASGFTFDDYAMHWVRQRPGKGLEWVAS<br>INWKGNSLAYGDSVKGRFAISRDNAKNTVFLQMNSLRTEDTAVYYCASHQ<br>GVAYYNYAMDVWGRGTLVTVSS |
| BCMA_EBB-C1979-C12-aa VL | 8105 | EIVLTQSPGTLSLSPGERATLSCRATQSIGSSFLAWYQQRPGQAPRLLIY<br>GASQRATGIPDRFSGRGSGTDFTLTISRVEPEDSAVYYCQHYESSPSWTF<br>GQGTKVEIK |
| BCMA_EBB-C1980-G4 | | |
| BCMA_EBB-C1980-G4-aa ScFv domain | 8043 | EVQLVESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKVV<br>RDGMDVWGQGTTVTVSSGGGGSGGGGSGGGGSEIVLTQSPATLSLSPGER<br>ATLSCRASQSVSSSYLAWYQQKPGQAPRLLIYGASSRATGIPDRFSGNGS<br>GTDFTLTISRLEPEDFAVYYCQQYGSPPRETFGPGTKVDIK |
| BCMA_EBB-C1980-G4-nt ScFv domain | 8064 | GAGGTGCAGTTGGTCGAAAGCGGGGGCGGGCTTGTGCAGCCTGGCGGATC<br>ACTGCGGCTGTCCTGCGCGGCATCAGGCTTCACGTTTTCTTCCTACGCCA<br>TGTCCTGGGTGCGCCAGGCCCCTGGAAAGGGACTGGAATGGGTGTCCGCG<br>ATTTCGGGGTCCGGCGGGAGCACCTACTACGCCGATTCCGTGAAGGGCCG<br>CTTCACTATCTCGCGGGACAACTCCAAGAACACCCTCTACCTCCAAATGA<br>ATAGCCTGCGGGCCGAGGATACCGCCGTCTACTATTGCGCTAAGGTCGTG<br>CGCGACGGAATGGACGTGTGGGGACAGGGTACCACCGTGACAGTGTCCTC<br>GGGGGGAGGCGGTAGCGGCGGAGGAGGAAGCGGTGGTGGAGGTTCCGAGA<br>TTGTGCTGACTCAATCACCCGCGACCCTGAGCCTGTCCCCCGGCGAAAGG<br>GCCACTCTGTCCTGTCGGGCCAGCCAATCAGTCTCCTCCTCGTACCTGGC<br>CTGGTACCAGCAGAAGCCAGGACAGGCTCCGAGACTCCTTATCTATGGCG<br>CATCCTCCCGCGCCACCGGAATCCCGGATAGGTTCTCGGGAAACGGATCG<br>GGGACCGACTTCACTCTCACCATCTCCCGGCTGGAACCGGAGGACTTCGC<br>CGTGTACTACTGCCAGCAGTACGGCAGCCCGCCTAGATTCACTTTCGGCC<br>CCGGCACCAAAGTGGACATCAAG |
| BCMA_EBB-C1980-G4-aa VH | 8085 | EVQLVESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKVV<br>RDGMDVWGQGTTVTVSS |
| BCMA_EBB-C1980-G4-aa VL | 8106 | EIVLTQSPATLSLSPGERATLSCRAsQsysSSYLAWYQQKPGQAPRLLIY<br>GASSRATGIPDRFSGNGSGTDFTLTISRLEPEDFAVYYCQQYGSPPRFTF<br>GPGTKVDIK |
| BCMA_EBB-C1980-D2 | | |
| BCMA_EBB-C1980-D2-aa ScFv domain | 8044 | EVQLLESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKIP<br>QTGTFDYWGQGTLVTVSSGGGGSGGGGSGGGGSEIVLTQSPGTLSLSPGE<br>RATLSCRASQSVSSSYLAWYQQRPGQAPRLLIYGASSRATGIPDRFSGSG<br>SGTDFTLTISRLEPEDFAVYYCQHYGSSPSWTFGQGTRLEIK |
| BCMA_EBB-C1980-D2-nt ScFv domain | 8065 | GAAGTGCAGCTGCTGGAGTCCGGCGGTGGATTGGTGCAACCGGGGGGATC<br>GCTCAGACTGTCCTGTGCGGCGTCAGGCTTCACCTTCTCGAGCTACGCCA<br>TGTCATGGGTCAGACAGGCCCCTGGAAAGGGTCTGGAATGGGTGTCCGCC<br>ATTTCCGGGAGCGGGGATCTACATACTACGCCGATAGCGTGAAGGGCCG<br>CTTCACCATTTCCCGGGACAACTCCAAGAACACTCTCTATCTGCAAATGA<br>ACTCCCTCCGCGCTGAGGACACTGCCGTGTACTACTGCGCCAAAATCCCT<br>CAGACCGGCACCTTCGACTACTGGGGACAGGGGACTCTGGTCACCGTCAG<br>CAGCGGTGGCGAGGTTCGGGGGAGGAGGAAGCGGCGGCGGAGGGTCCG<br>AGATTGTGCTGACCCAGTCACCCGGCACTTTGTCCCTGTCGCCTGGAGAA<br>AGGGCCACCCTTTCCTGCCGGGCATCCCAATCCGTGTCCTCCTCGTACCT<br>GGCCTGGTACCAGCAGAGGCCCGGACAGGCCCCACGGCTTCTGATCTACG<br>GAGCAAGCAGCCGCGCGACCGGTATCCCGGACCGGTTTTCGGGCTCGGGC<br>TCAGGAACTGACTTCACCCTCACCATCTCCCGCCTGGAACCCGAAGATTT<br>CGCTGTGTATTACTGCCAGCACTACGGCAGCTCCCCGTCCTGGACGTTCG<br>GCCAGGGAACTCGGCTGGAGATCAAG |
| BCMA_EBB-C1980-D2-aa VH | 8086 | EVQLLESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKIP<br>QTGTFDYWGQGTLVTVSS |

TABLE 18-continued

Antigen Binding domains that bind BCMA
The amino acid sequences variable heavy chain and variable light chain
sequences for each scFv is also provided.

| Name/ Description | SEQ ID NO: | Sequence |
|---|---|---|
| BCMA_EBB-C1980-D2-aa VL | 8107 | EIVLTQSPGTLSLSPGERATLSCRASQSVSSSYLAWYQQRPGQAPRLLIY GASSRATGIPDRFSGSGSGTDFTLTISRLEPEDFAVYYCQHYGSSPSWTF GQGTRLEIK |

BCMA_EBB-C1978-A10

| Name/ Description | SEQ ID NO: | Sequence |
|---|---|---|
| BCMA_EBB-C1978-A10-aa ScFv domain | 8045 | EVQLVETGGGLVQPGGSLRLSCAASGFTFSSYAMSWVRQAPGKGLEWVSA ISGSGGSTYYADSVKGRFTMSRENDKNSVFLQMNSLRVEDTGVYYCARAN YKRELRYYYGMDVWGQGTMVTVSSGGGGSGGGGSGGGGSEIVMTQSPGTL SLSPGESATLSCRASQRVASNYLAWYQHKPGQAPSLLISGASSRATGVPD RFSGSGSGTDFTLAISRLEPEDSAVYYCQHYDSSPSWTFGQGTKVEIK |
| BCMA_EBB-C1978-A10-nt ScFv domain | 8066 | GAAGTGCAACTGGTGGAAACCGGTGGAGGACTCGTGCAGCCTGGCGGCAG CCTCCGGCTGAGCTGCGCCGCTTCGGGATTCACCTTTTCCTCCTACGCGA TGTCTTGGGTCAGACAGGCCCCCGGAAAGGGGCTGGAATGGGTGTCAGCC ATCTCCGGCTCCGGCGGATCAACGTACTACGCCGACTCCGTGAAAGGCCG GTTCACCATGTCGCGCGAGAATGACAAGAACTCCGTGTTCCTGCAAATGA ACTCCCTGAGGGTGGAGGACACCGGAGTGTACTATTGTGCGCGCGCCAAC TACAAGAGAGAGCTGCGGTACTACTACGGAATGGACGTCTGGGGACAGGG AACTATGGTGACCGTGTCATCCGGTGGAGGGGGAAGCGGCGGTGGAGGCA GCGGGGGCGGGGGTTCAGAAATTGTCATGACCCAGTCCCCGGGAACTCTT TCCCTCTCCCCCGGGGAATCCGCGACTTTGTCCTGCCGGGCCAGCCAGCG CGTGGCCTCGAACTACCTCGCATGGTACCAGCATAAGCCAGGCCAAGCCC CTTCCCTGCTGATTTCCGGGGCTAGCAGCCGCGCCACTGGCGTGCCGGAT AGGTTCTCGGGAAGCGGCTCGGGTACCGATTTCACCCTGGCAATCTCGCG GCTGGAACCGGAGGATTCGGCCGTGTACTACTGCCAGCACTATGACTCAT CCCCCTCCTGGACATTCGGACAGGGCACCAAGGTCGAGATCAAG |
| BCMA_EBB-C1978-A10-aa VH | 8087 | EVQLVETGGGLVQPGGSLRLSCAASGFTFSSYAMSWVRQAPGKGLEWVSA ISGSGGSTYYADSVKGRFTMSRENDKNSVFLQMNSLRVEDTGVYYCARAN YKRELRYYYGMDVWGQGTMVTVSS |
| BCMA_EBB-C1978-A10-aa VL | 8108 | EIVMTQSPGTLSLSPGESATLSCRASQRVASNYLAWYQHKPGQAPSLLIS GASSRATGVPDRFSGSGSGTDFTLAISRLEPEDSAVYYCQHYDSSPSWTF GQGTKVEIK |

BCMA_EBB-C1978-D4

| Name/ Description | SEQ ID NO: | Sequence |
|---|---|---|
| BCMA_EBB-C1978-D4-aa ScFv domain | 8046 | EVQLLETGGGLVQPGGSLRLSCAASGFSFSSYAMSWVRQAPGKGLEWVSA ISGSGGSTYYADSVKGRFTISRDNSKNTLYLQMNSLRAEDTAVYYCAKAL VGATGAFDIWGQGTLVTVSSGGGGSGGGGSGGGGSEIVLTQSPGTLSLSP GERATLSCRASQSLSSNFLAWYQQKPGQAPGLLIYGASNWATGTPDRFSG SGSGTDFTLTITRLEPEDFAVYYCQYYGTSPMYTFGQGTKVEIK |
| BCMA_EBB-C1978-D4-nt ScFv domain | 8067 | GAAGTGCAGCTGCTCGAAACCGGTGGAGGGCTGGTGCAGCCAGGGGCTC CCTGAGGCTTTCATGCGCCGCTAGCGGATTCTCCTTCTCCTCTTACGCCA TGTCGTGGGTCCGCCAAGCCCCTGGAAAAGGCCTGGAATGGGTGTCCGCG ATTTCCGGGAGCGGAGGTTCGACCTATTACGCCGACTCCGTGAAGGGCCG CTTTACCATCTCCCGGGATAACTCCAAGAACACTCTGTACCTCCAAATGA ACTCGCTGAGAGCCGAGGACACCGCCGTGTATTACTGCGCGAAGGCGCTG GTCGGCGCGACTGGGGCATTCGACATCTGGGGACAGGGAACTCTTGTGAC CGTGTCGAGCGGAGGCGGCGGCTCCGGCGGAGGAGGGAGCGGGGGCGGTG GTTCCGAAATCGTGTTGACTCAGTCCCCGGGAACCCTGAGCTTGTCACCC GGGGAGCGGGCCACTCTCTCCTGTCGCGCCTCCCAATCGCTCTCATCCAA TTTCCTGGCCTGGTACCAGCAGAAGCCCGACAGGCCCCGGGCCTGCTCA TCTACGGCGCTTCAAACTGGGCAACGGGAACCCCTGATCGGTTCAGCGGA AGCGGATCGGGTACTGACTTTACCCTGACCATCACCAGACTGGAACCGGA GGACTTCGCCGTGTACTACTGCCAGTACTACGGCACCTCCCCCATGTACA CATTCGGACAGGGTACCAAGGTCGAGATTAAG |
| BCMA_EBB-C1978-D4-aa VH | 8088 | EVQLLETGGGLVQPGGSLRLSCAASGFSFSSYAMSWVRQAPGKGLEWVSA ISGSGGSTYYADSVKGRFTISRDNSKNTLYLQMNSLRAEDTAVYYCAKAL VGATGAFDIWGQGTLVTVSS |
| BCMA_EBB-C1978-D4-aa VL | 8109 | EIVLTQSPGTLSLSPGERATLSCRASQSLSSNFLAWYQQKPGQAPGLLIY GASNWATGTPDRFSGSGSGTDFTLTITRLEPEDFAVYYCQYYGTSPMYTF GQGTKVEIK |

BCMA_EBB-C1980-A2

| Name/ Description | SEQ ID NO: | Sequence |
|---|---|---|
| BCMA_EBB-C1980-A2-aa ScFv domain | 8047 | EVQLLESGGGLVQPGGSLRLSCAASGFTFSSYAMSWVRQAPGKGLEWVSA ISGSGGSTYYADSVKGRFTISRDNSKNTLYLQMNSLRAEDTAVYYCVLWF GEGFDPWGQGTLVTVSSGGGGSGGGGSGGGGSDIVLTQSPLSLPVTPGEP |

TABLE 18-continued

Antigen Binding domains that bind BCMA
The amino acid sequences variable heavy chain and variable light chain
sequences for each scFv is also provided.

| Name/Description | SEQ ID NO: | Sequence |
|---|---|---|
|  |  | ASISCRSSQSLLHSNGYNYLDWYLQKPGQSPQLLIYLGSNRASGVPDRFS<br>GSGSGTDFTLKISRVEAEDVGVYYCMQALQTPLTFGGGTKVDIK |
| BCMA_EBB-C1980-A2-nt<br>ScFv domain | 8068 | GAAGTGCAGCTGCTTGAGAGCGGTGGAGGTCTGGTGCAGCCCGGGGATC<br>ACTCGCCTGTCCTGTGCCGCGTCCGGTTTCACTTTCTCCTCGTACGCCA<br>TGTCGTGGGTCAGACAGGCACCGGGAAAGGGACTGGAATGGGTGTCAGCC<br>ATTTCGGGTTCGGGGGGCAGCACCTACTACGCTGACTCCGTGAAGGGCCG<br>GTTCACCATTTCCCGCGACAACTCCAAGAACACCTTGTACCTCCAAATGA<br>ACTCCCTGCGGGCCGAAGATACCGCCGTGTATTACTGCGTGCTGTGGTTC<br>GGAGAGGGATTCGACCCGTGGGGACAAGGAACACTCGTGACTGTGTCATC<br>CGGCGGAGGCGGCAGCGGTGGCGGCGGTTCCGGCGGCGGCGGATCTGACA<br>TCGTGTTGACCCAGTCCCCTCTGAGCCTGCCGGTCACTCCTGGCGAACCA<br>GCCAGCATCTCCTGCCGGTCGAGCCAGTCCCTCCTGCACTCCAATGGGTA<br>CAACTACCTCGATTGGTATCTGCAAAAGCCGGGCCAGAGCCCCCAGCTGC<br>TGATCTACCTTGGGTCAAACCGCGCTTCCGGGGTGCCTGATAGATTCTCC<br>GGGTCCGGGAGCGGAACCGACTTTACCCTGAAAATCTCGAGGGTGGAGGC<br>CGAGGACGTCGGAGTGTACTACTGCATGCAGGCGCTCCAGACTCCCCTGA<br>CCTTCGGAGGAGGAACGAAGGTCGACATCAAGA |
| BCMA_EBB-C1980-A2-aa<br>VH | 8089 | EVQLLESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCVLWF<br>GEGFDPWGQGTLVTVSS |
| BCMA_EBB-C1980-A2-aa<br>VL | 8110 | DIVLTQSPLSLPVTPGEPASISCRSSQSLLHSNGYNYLDWYLQKPGQSPQ<br>LLIYLGSNRASGVPDRFSGSGSGTDFTLKISRVEAEDVGVYYCMQALQTP<br>LTFGGGTKVDIK |
| BCMA_EBB-C1981-C3 |  |  |
| BCMA_EBB-C1981-C3-aa<br>ScFv domain | 8048 | QVQLVESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKVG<br>YDSSGYYRDYYGMDVWGQGTTVTVSSGGGGSGGGGSGGGGSEIVLTQSPG<br>TLSLSPGERATLSCRASQSVSSSYLAWYQQKPGQAPRLLIYGTSSRATGI<br>SDRFSGSGSGTDFTLTISRLEPEDFAVYYCQHYGNSPPKFTFGPGTKLEIK |
| BCMA_EBB-C1981-C3-nt<br>ScFv domain | 8069 | CAAGTGCAGCTCGTGGAGTCAGGCGGAGGACTGGTGCAGCCCGGGGGCTC<br>CCTGAGACTTTCCTGCGCGGCATCGGGTTTTACCTTCTCCTCCTATGCTA<br>TGTCCTGGGTGCGCCAGGCCCCGGGAAAGGGACTGGAATGGGTGTCCGCA<br>ATCAGCGGTAGCGGGGGCTCAACATACTACGCCGACTCCGTCAAGGGTCG<br>CTTCACTATTTCCCGGGACAACTCCAAGAATACCCTGTACCTCCAAATGA<br>ACAGCCTCAGGGCCGAGGATACTGCCGTGTACTACTGCGCCAAAGTCGGA<br>TACGATAGCTCCGGTTACTACCGGGACTACTACGGAATGGACGTGTGGGG<br>ACAGGGCACCACCGTGACCGTGTCAAGCGGCGGAGGCGGTTCAGGAGGGG<br>GAGGCTCCGGCGGTGGAGGGTCCGAAATCGTCCTGACTCAGTCGCCTGGC<br>ACTCTGTCGTTGTCCCCGGGGGAGCGCGCTACCCTGTCGTGTCGGGCGTC<br>GCAGTCCGTGTCGAGCTCCTACCTCGCGTGGTACCAGCAGAAGCCCGGAC<br>AGGCCCCTAGACTTCTGATCTACGGACACTTCTTCACGCGCCACCGGGATC<br>AGCGACAGGTTCAGCGGCTCCGGCTCCGGGACCGACTTCACCCTGACCAT<br>TAGCCGGCTGGAGCCTGAAGATTTCGCCGTGTATTACTGCCAACACTACG<br>GAAACTCGCCGCCAAAGTTCACGTTCGGACCCGGAACCAAGCTGGAAATC<br>AAG |
| BCMA_EBB-C1981-C3-aa<br>VH | 8090 | QVQLVESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKVG<br>YDSSGYYRDYYGMDVWGQGTTVTVSS |
| BCMA_EBB-C1981-C3-aa<br>VL | 8111 | EIVLTQSPGTLSLSPGERATLSCRASQSYSSSYLAWYQQKPGQAPRLLIY<br>GTSSRATGISDRFSGSGSGTDFTLTISRLEPEDFAVYYCQHYGNSPPKFT<br>FGPGTKLEIK |
| BCMA_EBB-C1978-G4 |  |  |
| BCMA_EBB-C1978-G4-aa<br>ScFv domain | 8049 | EVQLVESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKMG<br>WSSGYLGAFDIWGQGTTVTVSSGGGGSGGGGSGGGGSEIVLTQSPGTLSL<br>SPGERATLSCRASQSVASSFLAWYQQKPGQAPRLLIYGASGRATGIPDRF<br>SGSGSGTDFTLTISRLEPEDFAVYYCQHYGGSPRLTFGGGTKVDIK |
| BCMA_EBB-C1978-G4-nt<br>ScFv domain | 8070 | GAAGTCCAACTGGTGGAGTCCGGGGGAGGGCTCGTGCAGCCCGGAGGCAG<br>CCTTCGGCTGTCGTGCGCCGCCTCCGGGTTCACGTTCTCATCCTACGCGA<br>TGTCGTGGGTCAGACAGGCACCAGGAAAGGGACTGGAATGGGTGTCCGCC<br>ATTAGCGGCTCCGGCGGTAGCACCTACTATGCCGACTCAGTGAAGGGAAG<br>GTTCACTATCTCCCGCGACAACAGCAAGAACACCCTGTACCTCCAAATGA |

TABLE 18-continued

Antigen Binding domains that bind BCMA
The amino acid sequences variable heavy chain and variable light chain
sequences for each scFv is also provided.

| Name/<br>Description | SEQ ID<br>NO: | Sequence |
|---|---|---|
| | | ACTCTCTGCGGGCCGAGGATACCGCGGTGTACTATTGCGCCAAGATGGGT<br>TGGTCCAGCGGATACTTGGGAGCCTTCGACATTTGGGGACAGGGCACTAC<br>TGTGACCGTGTCCTCCGGGGGTGGCGGATCGGGAGGCGGCGGCTCGGGTG<br>GAGGGGGTTCCGAAATCGTGTTGACCCAGTCACCGGGAACCCTCTCGCTG<br>TCCCCGGGAGAACGGGCTACACTGTCATGTAGAGCGTCCCAGTCCGTGGC<br>TTCCTCGTTCCTGGCCTGGTACCAGCAGAAGCCGGGACAGGCACCCCGCC<br>TGCTCATCTACGGAGCCAGCGGCCGGGCGACCGGCATCCCTGACCGCTTC<br>TCCGGTTCCGGCTCGGGCACCGACTTTACTCTGACCATTAGCAGGCTTGA<br>GCCCGAGGATTTTGCCGTGTACTACTGCCAACACTACGGGGGGAGCCCTC<br>GCCTGACCTTCGGAGGCGGAACTAAGGTCGATATCAAAA |
| BCMA_EBB-<br>C1978-G4-aa<br>VH | 8091 | EVQLVESGGGLVQPGGSLRLSCAASGFTFSSYAMSWVRQAPGKGLEWVSA<br>ISGSGGSTYYADSVKGRFTISRDNSKNTLYLQMNSLRAEDTAVYYCAKMG<br>WSSGYLGAFDIWGQGTTVTVSS |
| BCMA_EBB-<br>C1978-G4-aa<br>VL | 8112 | EIVLTQSPGTLSLSPGERATLSCRASQSVASSFLAWYQQKPGQAPRLLIY<br>GASGRATGIPDRFSGSGSGTDFTLTISRLEPEDFAVYYCQHYGGSPRLTF<br>GGGTKVDIK |

In embodiments, additional exemplary BCMA CAR constructs are generated using the VH and VL sequences from PCT Publication WO2012/0163805 (the contents of which are hereby incorporated by reference in its entirety). In embodiments, additional exemplary BCMA CAR constructs are generated using the VH and VL sequences from PCT Publication WO2016/014565 (the contents of which are hereby incorporated by reference in its entirety). In embodiments, additional exemplary BCMA CAR constructs are generated using the VH and VL sequences from PCT Publication WO2014/122144 (the contents of which are hereby incorporated by reference in its entirety). In embodiments, additional exemplary BCMA CAR constructs are generated using the CAR molecules, and/or the VH and VL sequences from PCT Publication WO2016/014789 (the contents of which are hereby incorporated by reference in its entirety). In embodiments, additional exemplary BCMA CAR constructs are generated using the CAR molecules, and/or the VH and VL sequences from PCT Publication WO2014/089335 (the contents of which are hereby incorporated by reference in its entirety). In embodiments, additional exemplary BCMA CAR constructs are generated using the CAR molecules, and/or the VH and VL sequences from PCT Publication WO2014/140248 (the contents of which are hereby incorporated by reference in its entirety).

In embodiments, additional exemplary BCMA CAR constructs can also be generated using the VH and VL sequences found in Table 19. The amino acid sequences of exemplary scFv domains comprising the VH and VL domains and a linker sequence, and full-length CARs are also found in Table 19.

TABLE 19

Additional exemplary BCMA binding domain sequences

| Name | Sequence | SEQ ID<br>NO: |
|---|---|---|
| A7D12.2<br>VH | QIQLVQSGPDLKKPGETVKLSCKASGYTFTNFGMNWVKQAPGKGFKWMAWINTY<br>TGESYFADDFKGRFAFSVETSATTAYLQINNLKTEDTATYFCARGEIYYGYDGG<br>FAYWGQGTLVTVSA | 8155 |
| A7D12.2<br>VL | DVVMTQSHRFMSTSVGDRVSITCRASQDVNTAVSWYQQKPGQSPKLLIFSASYR<br>YTGVPDRFTGSGSGADFTLTISSVQAEDLAVYYCQQHYSTPWTFGGGTKLDIK | 8159 |
| A7D12.2<br>scFv<br>domain | QIQLVQSGPDLKKPGETVKLSCKASGYTFTNFGMNWVKQAPGKGFKWMAWINTY<br>TGESYFADDFKGRFAFSVETSATTAYLQINNLKTEDTATYFCARGEIYYGYDGG<br>FAYWGQGTLVTVSAGGGGSGGGGSGGGGSDVVMTQSHRFMSTSVGDRVSITCRA<br>SQDVNTAVSWYQQKPGQSPKLLIFSASYRYTGVPDRFTGSGSGADFTLTISSVQ<br>AEDLAVYYCQQHYSTPWTFGGGTKLDIK | 8163 |
| C11D5.3<br>VH | QIQLVQSGPELKKPGETVKISCKASGYTFTDYSINWVKRAPGKGLKWMGWINTE<br>TREPAYAYDFRGRFAFSLETSASTAYLQINNLKYEDTATYFCALDYSYAMDYWG<br>QGTSVTVSS | 8156 |
| C11D5.3<br>VL | DIVLTQSPASLAMSLGKRATISCRASESVSVIGAHLIHWYQQKPGQPPKLLIYL<br>ASNLETGVPARFSGSGSGTDFTLTIDPVEEDDVAIYSCLQSRIFPRTFGGGTKL<br>EIK | 8160 |
| C11D53<br>scFv<br>domain | QIQLVQSGPELKKPGETVKISCKASGYTFTDYSINWVKRAPGKGLKWMGWINTE<br>TREPAYAYDFRGRFAFSLETSASTAYLQINNLKYEDTATYFCALDYSYAMDYWG<br>QGTSVTVSSGGGGSGGGGSGGGGSQIQLVQSGPELKKPGETVKISCKASGYTFT | 8164 |

TABLE 19-continued

Additional exemplary BCMA binding domain sequences

| Name | Sequence | SEQ ID NO: |
|---|---|---|
|  | DYSINWVKRAPGKGLKWMGWINTETREPAYAYDFRGRFAFSLETSASTAYLQIN NLKYEDTATYFCALDYSYAMDYWGQGTSVTVSS |  |
| C12A3.2 VH | QIQLVQSGPELKKPGETVKISCKASGYTFRHYSMNWVKQAPGKGLKWMGRINTE SGVPIYADDFKGRFAFSVETSASTAYLVINNLKDEDTASYFCSNDYLYSLDFWG QGTALTVSS | 8157 |
| C12A3.2 VL | DIVLTQSPPSLAMSLGKRATISCRASESVTILGSHLIYWYQQKPGQPPTLLIQL ASNVQTGVPARFSGSGSRTDFTLTIDPVEEDDVAVYYCLQSRTIPRTFGGGTKL EIK | 8161 |
| C12A3.2 scFv domain | QIQLVQSGPELKKPGETVKISCKASGYTFRHYSMNWVKQAPGKGLKWMGRINTE SGVPIYADDFKGRFAFSVETSASTAYLVINNLKDEDTASYFCSNDYLYSLDFWG QGTALTVSSGGGGSGGGGSGGGGSDIVLTQSPPSLAMSLGKRATISCRASESVT ILGSHLIYWYQQKPGQPPTLLIQLASNVQTGVPARFSGSGSRTDFTLTIDPVEE DDVAVYYCLQSRTIPRTFGGGTKLEIK | 8165 |
| C13F12.1 VH | QIQLVQSGPELKKPGETVKISCKASGYTFTHYSMNWVKQAPGKGLKWMGRINTE TGEPLYADDFKGRFAFSLETSASTAYLVINNLKNEDTATFFCSNDYLYSCDYWG QGTTLTVSS | 8158 |
| C13F12.1 VL | DIVLTQSPPSLAMSLGKRATISCRASESVTILGSHLIYWYQQKPGQPPTLLIQL ASNVQTGVPARFSGSGSRTDFTLTIDPVEEDDVAVYYCLQSRTIPRTFGGGTKL EIK | 8162 |
| C13FE2.1 scFv domain | QIQLVQSGPELKKPGETVKISCKASGYTFTHYSMNWVKQAPGKGLKWMGRINTE TGEPLYADDFKGRFAFSLETSASTAYLVINNLKNEDTATFFCSNDYLYSCDYWG QGTTLTVSSGGGGSGGGGSGGGGSDIVLTQSPPSLAMSLGKRATISCRASESVT ILGSHLIYWYQQKPGQPPTLLIQLASNVQTGVPARFSGSGSRTDFTLTIDPVEE DDVAVYYCLQSRTIPRTFGGGTKLEIK | 8166 |

The sequences of human CDR sequences of the scFv domains are shown in Table 20 for the heavy chain variable domains and in Table 21 for the light chain variable domains. "ID" stands for the respective SEQ ID NO for each CDR. The CDRs are shown according to the Kabat definition, however, the CDRs under other convention, for example, Chothia or the combined Kabat/Chothia definitions may be readily deduced based on the VH and VL sequences above.

TABLE 20

Heavy Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | ID | HCDR2 | ID | HCDR3 | ID |
|---|---|---|---|---|---|---|
| 139109 | NHGMS | 8294 | GIVYSGSTYYAASVKG | 8334 | HGGESDV | 8374 |
| 139103 | NYAMS | 8284 | GISRSGENTYYADSVKG | 8324 | SPAHYYGGMDV | 8364 |
| 139105 | DYAMH | 8285 | GISWNSGSIGYADSVKG | 8325 | HSFLAY | 8365 |
| 139111 | NHGMS | 8286 | GIVYSGSTYYAASVKG | 8326 | HGGESDV | 8366 |
| 139100 | NFGIN | 8287 | WINPKNNNTNYAQKFQG | 8327 | GPYYYQSYMDV | 8367 |
| 139101 | SDAMT | 8288 | VISGSGGTTYYADSVKG | 8328 | LDSSGYYYARGPRY | 8368 |
| 139102 | NYGIT | 8289 | WISAYNGNTNYAQKFQG | 8329 | GPYYYYMDV | 8369 |
| 139104 | NHGMS | 8290 | GIVYSGSTYYAASVKG | 8330 | HGGESDV | 8370 |
| 139106 | NHGMS | 8291 | GIVYSGSTYYAASVKG | 8331 | HGGESDV | 8371 |

TABLE 20-continued

Heavy Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | ID | HCDR2 | ID | HCDR3 | ID |
|---|---|---|---|---|---|---|
| 139107 | NHGMS | 8292 | GIVYSGSTYYAASVKG | 8332 | HGGESDV | 8372 |
| 139108 | DYYMS | 8293 | YISSSGSTIYYADSVKG | 8333 | ESGDGMDV | 8373 |
| 139110 | DYYMS | 8295 | YISSSGNTIYYADSVKG | 8335 | STMVREDY | 8375 |
| 139112 | NHGMS | 8296 | GIVYSGSTYYAASVKG | 8336 | HGGESDV | 8376 |
| 139113 | NHGMS | 8297 | GIVYSGSTYYAASVKG | 8337 | HGGESDV | 8377 |
| 139114 | NHGMS | 8298 | GIVYSGSTYYAASVKG | 8338 | HGGESDV | 8378 |
| 149362 | SSYYWG | 8299 | SIYYSGSAYYNPSLKS | 8339 | HWQEWPDAFDI | 8379 |
| 149363 | TSGMCVS | 8300 | RIDWDEDKFYSTSLKT | 8340 | SGAGGTSATAFDI | 8380 |
| 149364 | SYSMN | 8301 | SISSSSSYIYYADSVKG | 8341 | TIAAVYAFDI | 8381 |
| 149365 | DYYMS | 8302 | YISSSGSTIYYADSVKG | 8342 | DLRGAFDI | 8382 |
| 149366 | SHYIH | 8303 | MINPSGGVTAYSQTLQG | 8343 | EGSGSGWYFDF | 8383 |
| 149367 | SGGYYWS | 8304 | YIYYSGSTYYNPSLKS | 8344 | AGIAARLRGAFDI | 8384 |
| 149368 | SYAIS | 8305 | GIIPIFGTANYAQKFQG | 8345 | RGGYQLLRWDVGLLRSAFDI | 8385 |
| 149369 | SNSAAWN | 8306 | RTYYRSKWYSFYAISLKS | 8346 | SSPEGLFLYWFDP | 8386 |
| BCMA_EBB-C1978-A4 | SYAMS | 8307 | AISGSGGSTYYADSVKG | 8347 | VEGSGSLDY | 8387 |
| BCMA_EBB-C1978-G1 | RYPMS | 8308 | GISDSGVSTYYADSAKG | 8348 | RAGSEASDI | 8388 |
| BCMA_EBB-C1979-C1 | SYAMS | 8309 | AISGSGGSTYYADSVKG | 8349 | ATYKRELRYYYGMDV | 8389 |
| BCMA_EBB-C1978-C7 | SYAMS | 8310 | AISGSGGSTYYADSVKG | 8350 | ATYKRELRYYYGMDV | 8390 |
| BCMA_EBB-C1978-D10 | DYAMH | 8311 | GISWNSGSIGYADSVKG | 8351 | VGKAVPDV | 8391 |
| BCMA_EBB-C1979-C12 | DYAMH | 8312 | SINWKGNSLAYGDSVKG | 8352 | HQGVAYYNYAMDV | 8392 |
| BCMA_EBB-C1980-G4 | SYAMS | 8313 | AISGSGGSTYYADSVKG | 8353 | VVRDGMDV | 8393 |
| BCMA_EBB-C1980-D2 | SYAMS | 8314 | AISGSGGSTYYADSVKG | 8354 | IPQTGTFDY | 8394 |

TABLE 20-continued

Heavy Chain Variable Domain CDRs according to the Kabat numbering scheme
(Kabat et al. (1991), "Sequences of Proteins of Immunological Interest,"
5th Ed. Public Health Service, National Institutes of Health, Bethesda, MD)

| Candidate | HCDR1 | ID | HCDR2 | ID | HCDR3 | ID |
| --- | --- | --- | --- | --- | --- | --- |
| BCMA_EBB-C1978-A10 | SYAMS | 8315 | AISGSGGSTYYADSVKG | 8355 | ANYKRELRYYYGMDV | 8395 |
| BCMA_EBB-C1978-D4 | SYAMS | 8316 | AISGSGGSTYYADSVKG | 8356 | ALVGATGAFDI | 8396 |
| BCMA_EBB-C1980-A2 | SYAMS | 8317 | AISGSGGSTYYADSVKG | 8357 | WFGEGFDP | 8397 |
| BCMA_EBB-C1981-C3 | SYAMS | 8318 | AISGSGGSTYYADSVKG | 8358 | VGYDSSGYYRDYYGMDV | 8398 |
| BCMA_EBB-C1978-G4 | SYAMS | 8319 | AISGSGGSTYYADSVKG | 8359 | MGWSSGYLGAFDI | 8399 |
| A7D12.2 | NFGMN | 8320 | WINTYTGESYFADDFKG | 8360 | GEIYYGYDGGFAY | 8400 |
| C11D5.3 | DYSIN | 8321 | WINTETREPAYAYDFRG | 8361 | DYSYAMDY | 8401 |
| C12A3.2 | HYSMN | 8322 | RINTESGVPIYADDFKG | 8362 | DYLYSLDF | 8402 |
| C13F12.1 | HYSMN | 8323 | RINTETGEPLYADDFKG | 8363 | DYLYSCDY | 8403 |

TABLE 21

Light Chain Variable Domain CDRs according to the Kabat numbering scheme
(Kabat et al. (1991), "Sequences of Proteins of Immunological Interest,"
5th Ed. Public Health Service, National Institutes of Health, Bethesda, MD)

| Candidate | LCDR1 | ID | LCDR2 | ID | LCDR3 | ID |
| --- | --- | --- | --- | --- | --- | --- |
| 139109 | RASQSISSYLN | 8414 | AASSLQS | 8454 | QQSYSTPYT | 8494 |
| 139103 | RASQSISSSFLA | 8404 | GASRRAT | 8444 | QQYHSSPSWT | 8484 |
| 139105 | RSSQSLLHSNGYNYLD | 8405 | LGSNRAS | 8445 | MQALQTPYT | 8485 |
| 139111 | KSSQSLLRNDGKTPLY | 8406 | EVSNRFS | 8446 | MQNIQFPS | 8486 |
| 139100 | RSSQSLLHSNGYNYLN | 8407 | LGSKRAS | 8447 | MQALQTPYT | 8487 |
| 139101 | RASQSISSYLN | 8408 | GASTLAS | 8448 | QQSYKRAS | 8488 |
| 139102 | RSSQSLLYSNGYNYVD | 8409 | LGSNRAS | 8449 | MQGRQFPYS | 8489 |
| 139104 | RASQSVSSNLA | 8410 | GASTRAS | 8450 | QQYGSSLT | 8490 |
| 139106 | RASQSVSSKLA | 8411 | GASIRAT | 8451 | QQYGSSSWT | 8491 |
| 139107 | RASQSVGSTNLA | 8412 | DASNRAT | 8452 | QQYGSSPPWT | 8492 |
| 139108 | RASQSISSYLN | 8413 | AASSLQS | 8453 | QQSYTLA | 8493 |
| 139110 | KSSESLVHNSGKTYLN | 8415 | EVSNRDS | 8455 | MQGTHWPGT | 8495 |
| 139112 | QASEDINKFLN | 8416 | DASTLQT | 8456 | QQYESLPLT | 8496 |

TABLE 21-continued

Light Chain Variable Domain CDRs according to the Kabat numbering scheme
(Kabat et al. (1991), "Sequences of Proteins of Immunological Interest,"
5th Ed. Public Health Service, National Institutes of Health, Bethesda, MD)

| Candidate | LCDR1 | ID | LCDR2 | ID | LCDR3 | ID |
|---|---|---|---|---|---|---|
| 139113 | RASQSVGSNLA | 8417 | GASTRAT | 8457 | QQYNDWLPVT | 8497 |
| 139114 | RASQSIGSSSLA | 8418 | GASSRAS | 8458 | QQYAGSPPFT | 8498 |
| 149362 | KASQDIDDAMN | 8419 | SATSPVP | 8459 | LQHDNFPLT | 8499 |
| 149363 | RASQDIYNNLA | 8420 | AANKSQS | 8460 | QHYYRFPYS | 8500 |
| 149364 | RSSQSLLHSNGYNYLD | 8421 | LGSNRAS | 8461 | MQALQTPYT | 8501 |
| 149365 | GGNNIGTKSVH | 8422 | DDSVRPS | 8462 | QVWDSDSEHVV | 8502 |
| 149366 | SGDGLSKKYVS | 8423 | RDKERPS | 8463 | QAWDDTTVV | 8503 |
| 149367 | RASQGIRNWLA | 8424 | AASNLQS | 8464 | QKYNSAPFT | 8504 |
| 149368 | GGNNIGSKSVH | 8425 | GKNNRPS | 8465 | SSRDSSGDHLRV | 8505 |
| 149369 | QGDSLGNYYAT | 8426 | GTNNRPS | 8466 | NSRDSSGHHLL | 8506 |
| BCMA_EBB-C1978-A4 | RASQSVSSAYLA | 8427 | GASTRAT | 8467 | QHYGSSFNGSSLFT | 8507 |
| BCMA_EBB-C1978-G1 | RASQSVSNSLA | 8428 | DASSRAT | 8468 | QQFGTSSGLT | 8508 |
| BCMA_EBB-C1979-C1 | RASQSVSSSFLA | 8429 | GASSRAT | 8469 | QQYHSSPSWT | 8509 |
| BCMA_EBB-C1978-C7 | RASQSVSTTFLA | 8430 | GSSNRAT | 8470 | QQYHSSPSWT | 8510 |
| BCMA_EBB-C1978-D10 | RASQSISSYLN | 8431 | AASSLQS | 8471 | QQSYSTPYS | 8511 |
| BCMA_EBB-C1979-C12 | RATQSIGSSFLA | 8432 | GASQRAT | 8472 | QHYESSPSWT | 8512 |
| BCMA_EBB-C1980-G4 | RASQSVSSSYLA | 8433 | GASSRAT | 8473 | QQYGSPPRFT | 8513 |
| BCMA_EBB-C1980-D2 | RASQSVSSSYLA | 8434 | GASSRAT | 8474 | QHYGSSPSWT | 8514 |
| BCMA_EBB-C1978-A10 | RASQRVASNYLA | 8435 | GASSRAT | 8475 | QHYDSSPSWT | 8515 |
| BCMA_EBB-C1978-D4 | RASQSLSSNFLA | 8436 | GASNWAT | 8476 | QYYGTSPMYT | 8516 |
| BCMA_EBB-C1980-A2 | RSSQSLLHSNGYNYLD | 8437 | LGSNRAS | 8477 | MQALQTPLT | 8517 |
| BCMA_EBB-C1981-C3 | RASQSVSSSYLA | 8438 | GTSSRAT | 8478 | QHYGNSPPKFT | 8518 |
| BCMA_EBB-C1978-G4 | RASQSVASSFLA | 8439 | GASGRAT | 8479 | QHYGGSPRLT | 8519 |
| A7D12.2 | RASQDVNTAVS | 8440 | SASYRYT | 8480 | QQHYSTPWT | 8520 |
| C11D5.3 | RASESVSVIGAHLIH | 8441 | LASNLET | 8481 | LQSRIFPRT | 8521 |
| C12A3.2 | RASESVTILGSHLIY | 8442 | LASNVQT | 8482 | LQSRTIPRT | 8522 |
| C13F12.1 | RASESVTILGSHLIY | 8443 | LASNVQT | 8483 | LQSRTIPRT | 8523 |

In one embodiment, the BCMA binding domain comprises one or more (e.g., all three) light chain complementary determining region 1 (LC CDR1), light chain complementary determining region 2 (LC CDR2), and light chain complementary determining region 3 (LC CDR3) of a BCMA binding domain described herein, e.g., provided in Table 18, 19 or 21, and/or one or more (e.g., all three) heavy chain complementary determining region 1 (HC CDR1), heavy chain complementary determining region 2 (HC CDR2), and heavy chain complementary determining region 3 (HC CDR3) of a BCMA binding domain described herein, e.g., provided in Table 18, 19 or 20. In one embodiment, the BCMA binding domain comprises one, two, or all of LC CDR1, LC CDR2, and LC CDR3 of any amino acid sequences as provided in Table 18, incorporated herein by reference; and one, two or all of HC CDR1, HC CDR2, and HC CDR3 of any amino acid sequences as provided in Table 18.

In one embodiment, the BCMA antigen binding domain comprises:

(i) (a) a LC CDR1 amino acid sequence of SEQ ID NO: 8414, a LC CDR2 amino acid sequence of SEQ ID NO: 8454, and a LC CDR3 amino acid sequence of SEQ ID NO: 8494; and
  (b) a HC CDR1 amino acid sequence of SEQ ID NO: 8294, a HC CDR2 amino acid sequence of SEQ ID NO: 8334, and a HC CDR3 amino acid sequence of SEQ ID NO: 8374

(ii) (a) a LC CDR1 amino acid sequence of SEQ ID NO: 8404, a LC CDR2 amino acid sequence of SEQ ID NO: 8444, and a LC CDR3 amino acid sequence of SEQ ID NO: 8484; and
  (b) a HC CDR1 amino acid sequence of SEQ ID NO: 8284, a HC CDR2 amino acid sequence of SEQ ID NO: 8324, and a HC CDR3 amino acid sequence of SEQ ID NO: 8364

(iii) (a) a LC CDR1 amino acid sequence of SEQ ID NO: 8405, a LC CDR2 amino acid sequence of SEQ ID NO: 8445, and a LC CDR3 amino acid sequence of SEQ ID NO: 8485; and
  (b) a HC CDR1 amino acid sequence of SEQ ID NO: 8285, a HC CDR2 amino acid sequence of SEQ ID NO: 8325, and a HC CDR3 amino acid sequence of SEQ ID NO: 8365

(iv) (a) a LC CDR1 amino acid sequence of SEQ ID NO: 8406, a LC CDR2 amino acid sequence of SEQ ID NO: 8446, and a LC CDR3 amino acid sequence of SEQ ID NO: 8486; and
  (b) a HC CDR1 amino acid sequence of SEQ ID NO: 8286, a HC CDR2 amino acid sequence of SEQ ID NO: 8326, and a HC CDR3 amino acid sequence of SEQ ID NO: 8366

(v) (a) a LC CDR1 amino acid sequence of SEQ ID NO: 8407, a LC CDR2 amino acid sequence of SEQ ID NO: 8447, and a LC CDR3 amino acid sequence of SEQ ID NO: 8487; and
  (b) a HC CDR1 amino acid sequence of SEQ ID NO: 8287, a HC CDR2 amino acid sequence of SEQ ID NO: 8327, and a HC CDR3 amino acid sequence of SEQ ID NO: 8367

(vi) (a) a LC CDR1 amino acid sequence of SEQ ID NO: 8408, a LC CDR2 amino acid sequence of SEQ ID NO: 8448, and a LC CDR3 amino acid sequence of SEQ ID NO: 8488; and
  (b) a HC CDR1 amino acid sequence of SEQ ID NO: 8288, a HC CDR2 amino acid sequence of SEQ ID NO: 8328, and a HC CDR3 amino acid sequence of SEQ ID NO: 8368

(vii) (a) a LC CDR1 amino acid sequence of SEQ ID NO: 8409, a LC CDR2 amino acid sequence of SEQ ID NO: 8449, and a LC CDR3 amino acid sequence of SEQ ID NO: 8489; and
  (b) a HC CDR1 amino acid sequence of SEQ ID NO: 8289, a HC CDR2 amino acid sequence of SEQ ID NO: 8329, and a HC CDR3 amino acid sequence of SEQ ID NO: 8369

(viii) (a) a LC CDR1 amino acid sequence of SEQ ID NO: 8410, a LC CDR2 amino acid sequence of SEQ ID NO: 8450, and a LC CDR3 amino acid sequence of SEQ ID NO: 8490; and
  (b) a HC CDR1 amino acid sequence of SEQ ID NO: 8290, a HC CDR2 amino acid sequence of SEQ ID NO: 8330, and a HC CDR3 amino acid sequence of SEQ ID NO: 8370

(ix) (a) a LC CDR1 amino acid sequence of SEQ ID NO: 8411, a LC CDR2 amino acid sequence of SEQ ID NO: 8451, and a LC CDR3 amino acid sequence of SEQ ID NO: 8491; and
  (b) a HC CDR1 amino acid sequence of SEQ ID NO: 8291, a HC CDR2 amino acid sequence of SEQ ID NO: 8331, and a HC CDR3 amino acid sequence of SEQ ID NO: 8371

(x) (a) a LC CDR1 amino acid sequence of SEQ ID NO: 8412, a LC CDR2 amino acid sequence of SEQ ID NO: 8452, and a LC CDR3 amino acid sequence of SEQ ID NO: 8492; and
  (b) a HC CDR1 amino acid sequence of SEQ ID NO: 8292, a HC CDR2 amino acid sequence of SEQ ID NO: 8332, and a HC CDR3 amino acid sequence of SEQ ID NO: 8372

(xi) (a) a LC CDR1 amino acid sequence of SEQ ID NO: 8413, a LC CDR2 amino acid sequence of SEQ ID NO: 8453, and a LC CDR3 amino acid sequence of SEQ ID NO: 8493; and
  (b) a HC CDR1 amino acid sequence of SEQ ID NO: 8293, a HC CDR2 amino acid sequence of SEQ ID NO: 8333, and a HC CDR3 amino acid sequence of SEQ ID NO: 8373

(xii) (a) a LC CDR1 amino acid sequence of SEQ ID NO: 8415, a LC CDR2 amino acid sequence of SEQ ID NO: 8455, and a LC CDR3 amino acid sequence of SEQ ID NO: 8495; and
  (b) a HC CDR1 amino acid sequence of SEQ ID NO: 8295, a HC CDR2 amino acid sequence of SEQ ID NO: 8335, and a HC CDR3 amino acid sequence of SEQ ID NO: 8375

(xiii) (a) a LC CDR1 amino acid sequence of SEQ ID NO: 8416, a LC CDR2 amino acid sequence of SEQ ID NO: 8456, and a LC CDR3 amino acid sequence of SEQ ID NO: 8496; and
  (b) a HC CDR1 amino acid sequence of SEQ ID NO: 8296, a HC CDR2 amino acid sequence of SEQ ID NO: 8336, and a HC CDR3 amino acid sequence of SEQ ID NO: 8376

(xiv) (a) a LC CDR1 amino acid sequence of SEQ ID NO: 8417, a LC CDR2 amino acid sequence of SEQ ID NO: 8457, and a LC CDR3 amino acid sequence of SEQ ID NO: 8497; and (b) a HC CDR1 amino acid sequence of SEQ ID NO: 8297, a HC CDR2 amino acid sequence of SEQ ID NO: 8337, and a HC CDR3 amino acid sequence of SEQ ID NO: 8377

(xv) (a) a LC CDR1 amino acid sequence of SEQ ID NO: 8418, a LC CDR2 amino acid sequence of SEQ ID NO: 8458, and a LC CDR3 amino acid sequence of SEQ ID NO: 8498; and (b) a HC CDR1 amino acid sequence of SEQ ID NO: 8298, a HC CDR2 amino acid sequence of SEQ ID NO: 8338, and a HC CDR3 amino acid sequence of SEQ ID NO: 8378

(xvi) (a) a LC CDR1 amino acid sequence of SEQ ID NO: 8419, a LC CDR2 amino acid sequence of SEQ ID NO: 8459, and a LC CDR3 amino acid sequence of SEQ ID NO: 8499; and (b) a HC CDR1 amino acid sequence of SEQ ID NO: 8299, a HC CDR2 amino acid sequence of SEQ ID NO: 8339, and a HC CDR3 amino acid sequence of SEQ ID NO: 8379

(xvii) (a) a LC CDR1 amino acid sequence of SEQ ID NO: 8420, a LC CDR2 amino acid sequence of SEQ ID NO: 8460, and a LC CDR3 amino acid sequence of SEQ ID NO: 8500; and (b) a HC CDR1 amino acid sequence of SEQ ID NO: 8300, a HC CDR2 amino acid sequence of SEQ ID NO: 8340, and a HC CDR3 amino acid sequence of SEQ ID NO: 8380

(xviii) (a) a LC CDR1 amino acid sequence of SEQ ID NO: 8421, a LC CDR2 amino acid sequence of SEQ ID NO: 8461, and a LC CDR3 amino acid sequence of SEQ ID NO: 8501; and (b) a HC CDR1 amino acid sequence of SEQ ID NO: 8301, a HC CDR2 amino acid sequence of SEQ ID NO: 8341, and a HC CDR3 amino acid sequence of SEQ ID NO: 8381

(xix) (a) a LC CDR1 amino acid sequence of SEQ ID NO: 8422, a LC CDR2 amino acid sequence of SEQ ID NO: 8462, and a LC CDR3 amino acid sequence of SEQ ID NO: 8502; and (b) a HC CDR1 amino acid sequence of SEQ ID NO: 8302, a HC CDR2 amino acid sequence of SEQ ID NO: 8342, and a HC CDR3 amino acid sequence of SEQ ID NO: 8382

(xx) (a) a LC CDR1 amino acid sequence of SEQ ID NO: 8423, a LC CDR2 amino acid sequence of SEQ ID NO: 8463, and a LC CDR3 amino acid sequence of SEQ ID NO: 8503; and (b) a HC CDR1 amino acid sequence of SEQ ID NO: 8303, a HC CDR2 amino acid sequence of SEQ ID NO: 8343, and a HC CDR3 amino acid sequence of SEQ ID NO: 8383

(xxi) (a) a LC CDR1 amino acid sequence of SEQ ID NO: 8424, a LC CDR2 amino acid sequence of SEQ ID NO: 8464, and a LC CDR3 amino acid sequence of SEQ ID NO: 8504; and (b) a HC CDR1 amino acid sequence of SEQ ID NO: 8304, a HC CDR2 amino acid sequence of SEQ ID NO: 8344, and a HC CDR3 amino acid sequence of SEQ ID NO: 8384

(xxii) (a) a LC CDR1 amino acid sequence of SEQ ID NO: 8425, a LC CDR2 amino acid sequence of SEQ ID NO: 8465, and a LC CDR3 amino acid sequence of SEQ ID NO: 8505; and (b) a HC CDR1 amino acid sequence of SEQ ID NO: 8305, a HC CDR2 amino acid sequence of SEQ ID NO: 8345, and a HC CDR3 amino acid sequence of SEQ ID NO: 8385 or (xxiii) (a) a LC CDR1 amino acid sequence of SEQ ID NO: 8426, a LC CDR2 amino acid sequence of SEQ ID NO: 8466, and a LC CDR3 amino acid sequence of SEQ ID NO: 8506; and (b) a HC CDR1 amino acid sequence of SEQ ID NO: 8306, a HC CDR2 amino acid sequence of SEQ ID NO: 8346, and a HC CDR3 amino acid sequence of SEQ ID NO: 8386.

In one embodiment, the BCMA binding domain comprises a light chain variable region described herein (e.g., in Table 18 or 19) and/or a heavy chain variable region described herein (e.g., in Table 18 or 19). In one embodiment, the BCMA binding domain is a scFv comprising a light chain and a heavy chain of an amino acid sequence listed in Table 18 or 19. In an embodiment, the BCMA binding domain (e.g., an scFv) comprises: a light chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a light chain variable region provided in Table 18 or 19, or a sequence with 95-99% identity with an amino acid sequence provided in Table 18 or 19; and/or a heavy chain variable region comprising an amino acid sequence having at least one, two or three modifications (e.g., substitutions, e.g., conservative substitutions) but not more than 30, 20 or 10 modifications (e.g., substitutions, e.g., conservative substitutions) of an amino acid sequence of a heavy chain variable region provided in Table 18 or 19, or a sequence with 95-99% identity to an amino acid sequence provided in Table 18 or 19.

In one embodiment, the BCMA binding domain comprises an amino acid sequence selected from a group consisting of SEQ ID NO: 7949; SEQ ID NO: 7939, SEQ ID NO: 7940; SEQ ID NO: 7941; SEQ ID NO: 7942; SEQ ID NO: 7943; SEQ ID NO: 7944, SEQ ID NO: 7945, SEQ ID NO: 7946, SEQ ID NO: 7947, SEQ ID NO: 7948, SEQ ID NO: 7950, SEQ ID NO: 7951, SEQ ID NO: 7952, SEQ ID NO: 7953, SEQ ID NO: 8029, SEQ ID NO: 8030, SEQ ID NO: 8031, SEQ ID NO: 8032, SEQ ID NO: 8033, SEQ ID NO: 8034, SEQ ID NO: 8035, SEQ ID NO: 8036, SEQ ID NO: 8037, SEQ ID NO: 8038, SEQ ID NO: 8039, SEQ ID NO: 8040, SEQ ID NO: 8041, SEQ ID NO: 8042, SEQ ID NO: 8043, SEQ ID NO: 8044, SEQ ID NO: 8045, SEQ ID NO: 8046, SEQ ID NO: 8047, SEQ ID NO: 8048, SEQ ID NO: 8049, SEQ ID NO: 8163, SEQ ID NO: 8164, SEQ ID NO: 8165 and SEQ ID NO: 8166; or an amino acid sequence having at least one, two or three modifications (e.g., substitutions, e.g., conservative substitutions) but not more than 30, 20 or 10 modifications (e.g., substitutions, e.g., conservative substitutions) to any of the aforesaid sequences; or a sequence with 95-99% identity to any of the aforesaid sequences. In one embodiment, the BCMA binding domain is a scFv, and a light chain variable region comprising an amino acid sequence described herein, e.g., in Table 18 or 19, is attached to a heavy chain variable region comprising an amino acid sequence described herein, e.g., in Table 18 or 19, via a linker, e.g., a linker described herein. In one embodiment, the BCMA binding domain includes a (Gly4-Ser)n linker, wherein n is 1, 2, 3, 4, 5, or 6, preferably 3 (SEQ ID NO: 10801). The light chain variable region and heavy chain variable region of a scFv can be, e.g., in any of the following orientations: light chain variable region-linker-heavy chain variable region or heavy chain variable region-linker-light chain variable region.

Any known BCMA CAR, e.g., the BMCA antigen binding domain of any known BCMA CAR, in the art can be used in accordance with the instant invention. For example, those described herein.

Exemplary CAR Molecules

In one aspect, a CAR, e.g., a CAR expressed by the cell of the invention, comprises a CAR molecule comprising an antigen binding domain that binds to a B cell antigen, e.g., as described herein, such as CD19 or BCMA.

In one embodiment, the CAR comprises a CAR molecule comprising a CD19 antigen binding domain (e.g., a murine, human or humanized antibody or antibody fragment that specifically binds to CD19), a transmembrane domain, and an intracellular signaling domain (e.g., an intracellular signaling domain comprising a costimulatory domain and/or a primary signaling domain).

Exemplary CAR molecules described herein are provided in Table 22. The CAR molecules in Table 22 comprise a CD19 antigen binding domain, e.g., an amino acid sequence of any CD19 antigen binding domain provided in Table 14.

TABLE 22

Exemplary CD19 CAR molecules

| Antigen | Name | Amino Acid Sequence | SEQ ID NO: |
|---------|------|---------------------|------------|
| CD19 | CTL019 | MALPVTALLLPLALLLHAARPDIQMTQTTSSLSASLGDRVTISCRASQ DISKYLNWYQQKPDGTVKLLIYHTSRLHSGVPSRFSGSGSGTDYSLTI SNLEQEDIATYFCQQGNTLPYTFGGGTKLEITGGGSGGGGSGGGGSE VKLQESGPGLVAPSQSLSVTCTVSGVSLPDYGVSWIRQPPRKGLEWLG VIWGSETTYYNSALKSRLTIIKDNSKSQVFLKMNSLQTDDTAIYYCAK HYYYGGSYAMDYWGQGTSVTVSSTTTPAPRPPTPAPTIASQPLSLRPE ACRPAAGGAVHTRGLDFACDIYIWAPLAGTCGVLLLSLVITLYCKRGR KKLLYIFKQPFMRPVQTTQEEDGCSCRFPEEEEGGCELRVKFSRSADA PAYKQGQNQLYNELNLGRREEYDVLDKRRGRDPEMGGKPRRKNPQEGL YNELQKDKMAEAYSEIGMKGERRRGKGHDGLYQGLSTATKDTYDALHM QALPPR | 7920 |
| CD19 | CAR 1 | MALPVTALLLPLALLLHAARPEIVMTQSPATLSLSPGERATLSCRASQ DISKYLNWYQQKPGQAPRLLIYHTSRLHSGIPARFSGSGSGTDYTLTI SSLQPEDFAVYFCQQGNTLPYTFGQGTKLEIKGGGSGGGGSGGGGSQ VQLQESGPGLVKPSETLSLTCTVSGVSLPDYGVSWIRQPPGKGLEWIG VIWGSETTYYSSSLKSRVTISKDNSKNQVSLKLSSVTAADTAVYYCAK HYYYGGSYAMDYWGQGTLVTVSSTTTPAPRPPTPAPTIASQPLSLRPE ACRPAAGGAVHTRGLDFACDIYIWAPLAGTCGVLLLSLVITLYCKRGR KKLLYIFKQPFMRPVQTTQEEDGCSCRFPEEEEGGCELRVKFSRSADA PAYKQGQNQLYNELNLGRREEYDVLDKRRGRDPEMGGKPRRKNPQEGL YNELQKDKMAEAYSEIGMKGERRRGKGHDGLYQGLSTATKDTYDALHM QALPPR | 7908 |
| CD19 | CAR 2 | MALPVTALLLPLALLLHAARPEIVMTQSPATLSLSPGERATLSCRASQ DISKYLNWYQQKPGQAPRLLIYHTSRLHSGIPARFSGSGSGTDYTLTI SSLQPEDFAVYFCQQGNTLPYTFGQGTKLEIKGGGSGGGGSGGGGSQ VQLQESGPGLVKPSETLSLTCTVSGVSLPDYGVSWIRQPPGKGLEWIG VIWGSETTYYQSSLKSRVTISKDNSKNQVSLKLSSVTAADTAVYYCAK HYYYGGSYAMDYWGQGTLVTVSSTTTPAPRPPTPAPTIASQPLSLRPE ACRPAAGGAVHTRGLDFACDIYIWAPLAGTCGVLLLSLVITLYCKRGR KKLLYIFKQPFMRPVQTTQEEDGCSCRFPEEEEGGCELRVKFSRSADA PAYKQGQNQLYNELNLGRREEYDVLDKRRGRDPEMGGKPRRKNPQEGL YNELQKDKMAEAYSEIGMKGERRRGKGHDGLYQGLSTATKDTYDALHM QALPPR | 7909 |
| CD19 | CAR 3 | MALPVTALLLPLALLLHAARPQVQLQESGPGLVKPSETLSLTCTVSGV SLPDYGVSWIRQPPGKGLEWIGVIWGSETTYYSSSLKSRVTISKDNSK NQVSLKLSSVTAADTAVYYCAKHYYYGGSYAMDYWGQGTLVTVSSGGG GSGGGGSGGGGSEIVMTQSPATLSLSPGERATLSCRASQDISKYLNWY QQKPGQAPRLLIYHTSRLHSGIPARFSGSGSGTDYTLTISSLQPEDFA VYFCQQGNTLPYTFGQGTKLEIKTTTPAPRPPTPAPTIASQPLSLRPE ACRPAAGGAVHTRGLDFACDIYIWAPLAGTCGVLLLSLVITLYCKRGR KKLLYIFKQPFMRPVQTTQEEDGCSCRFPEEEEGGCELRVKFSRSADA PAYKQGQNQLYNELNLGRREEYDVLDKRRGRDPEMGGKPRRKNPQEGL YNELQKDKMAEAYSEIGMKGERRRGKGHDGLYQGLSTATKDTYDALHM QALPPR | 7910 |
| CD19 | CAR 4 | MALPVTALLLPLALLLHAARPQVQLQESGPGLVKPSETLSLTCTVSGV SLPDYGVSWIRQPPGKGLEWIGVIWGSETTYYQSSLKSRVTISKDNSK NQVSLKLSSVTAADTAVYYCAKHYYYGGSYAMDYWGQGTLVTVSSGGG GSGGGGSGGGGSEIVMTQSPATLSLSPGERATLSCRASQDISKYLNWY QQKPGQAPRLLIYHTSRLHSGIPARFSGSGSGTDYTLTISSLQPEDFA VYFCQQGNTLPYTFGQGTKLEIKTTTPAPRPPTPAPTIASQPLSLRPE ACRPAAGGAVHTRGLDFACDIYIWAPLAGTCGVLLLSLVITLYCKRGR KKLLYIFKQPFMRPVQTTQEEDGCSCRFPEEEEGGCELRVKFSRSADA PAYKQGQNQLYNELNLGRREEYDVLDKRRGRDPEMGGKPRRKNPQEGL YNELQKDKMAEAYSEIGMKGERRRGKGHDGLYQGLSTATKDTYDALHM QALPPR | 7911 |

TABLE 22-continued

Exemplary CD19 CAR molecules

| Antigen | Name | Amino Acid Sequence | SEQ ID NO: |
|---|---|---|---|
| CD19 | CAR 5 | MALPVTALLLPLALLLHAARPEIVMTQSPATLSLSPGERATLSCRASQ DISKYLNWYQQKPGQAPRLLIYHTSRLHSGIPARFSGSGSGTDYTLTI SSLQPEDFAVYFCQQGNTLPYTFGQGTKLEIKGGGGSGGGGSGGGGS GGGSQVQLQESGPGLVKPSETLSLTCTVSGVSLPDYGVSWIRQPPGKG LEWIGVIWGSETTYYSSSLKSRVTISKDNSKNQVSLKLSSVTAADTAV YYCAKHYYYGGSYAMDYWGQGTLVTVSSTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR | 7912 |
| CD19 | CAR 6 | MALPVTALLLPLALLLHAARPEIVMTQSPATLSLSPGERATLSCRASQ DISKYLNWYQQKPGQAPRLLIYHTSRLHSGIPARFSGSGSGTDYTLTI SSLQPEDFAVYFCQQGNTLPYTFGQGTKLEIKGGGGSGGGGSGGGGS GGGSQVQLQESGPGLVKPSETLSLTCTVSGVSLPDYGVSWIRQPPGKG LEWIGVIWGSETTYYQSSLKSRVTISKDNSKNQVSLKLSSVTAADTAV YYCAKHYYYGGSYAMDYWGQGTLVTVSSTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR | 7913 |
| CD19 | CAR 7 | MALPVTALLLPLALLLHAARPQVQLQESGPGLVKPSETLSLTCTVSGV SLPDYGVSWIRQPPGKGLEWIGVIWGSETTYYSSSLKSRVTISKDNSK NQVSLKLSSVTAADTAVYYCAKHYYYGGSYAMDYWGQGTLVTVSSGGG GSGGGGSGGGGSGGGGSEIVMTQSPATLSLSPGERATLSCRASQDISK YLNWYQQKPGQAPRLLIYHTSRLHSGIPARFSGSGSGTDYTLTISSLQ PEDFAVYFCQQGNTLPYTFGQGTKLEIKTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR | 7914 |
| CD19 | CAR 8 | MALPVTALLLPLALLLHAARPQVQLQESGPGLVKPSETLSLTCTVSGV SLPDYGVSWIRQPPGKGLEWIGVIWGSETTYYQSSLKSRVTISKDNSK NQVSLKLSSVTAADTAVYYCAKHYYYGGSYAMDYWGQGTLVTVSSGGG GSGGGGSGGGGSGGGGSEIVMTQSPATLSLSPGERATLSCRASQDISK YLNWYQQKPGQAPRLLIYHTSRLHSGIPARFSGSGSGTDYTLTISSLQ PEDFAVYFCQQGNTLPYTFGQGTKLEIKTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR | 7915 |
| CD19 | CAR 9 | MALPVTALLLPLALLLHAARPEIVMTQSPATLSLSPGERATLSCRASQ DISKYLNWYQQKPGQAPRLLIYHTSRLHSGIPARFSGSGSGTDYTLTI SSLQPEDFAVYFCQQGNTLPYTFGQGTKLEIKGGGGSGGGGSGGGGS GGGSQVQLQESGPGLVKPSETLSLTCTVSGVSLPDYGVSWIRQPPGKG LEWIGVIWGSETTYYNSLKSRVTISKDNSKNQVSLKLSSVTAADTAV YYCAKHYYYGGSYAMDYWGQGTLVTVSSTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR | 7916 |
| CD19 | CAR 10 | MALPVTALLLPLALLLHAARPEIVMTQSPATLSLSPGERATLSCRASQ DISKYLNWYQQKPGQAPRLLIYHTSRLHSGIPARFSGSGSGTDYTLTI SSLQPEDFAVYFCQQGNTLPYTFGQGTKLEIKGGGGSGGGGSGGGGS GGGSQVQLQESGPGLVKPSETLSLTCTVSGVSLPDYGVSWIRQPPGKG LEWIGVIWGSETTYYNSSLKSRVTISKDNSKNQVSLKLSSVTAADTAV YYCAKHYYYGGSYAMDYWGQGTLVTVSSTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR | 7917 |
| CD19 | CAR 11 | MALPVTALLLPLALLLHAARPQVQLQESGPGLVKPSETLSLTCTVSGV SLPDYGVSWIRQPPGKGLEWIGVIWGSETTYYNSSLKSRVTISKDNSK | 7918 |

TABLE 22-continued

Exemplary CD19 CAR molecules

| Antigen | Name | Amino Acid Sequence | SEQ ID NO: |
|---|---|---|---|
| | | NQVSLKLSSVTAADTAVYYCAKHYYYGGSYAMDYWGQGTLVTVSSGGG GSGGGGSGGGGSGGGGSEIVMTQSPATLSLSPGERATLSCRASQDISK YLNWYQQKPGQAPRLLIYHTSRLHSGIPARFSGSGSGTDYTLTISSLQ PEDFAVYFCQQGNTLPYTFGQGTKLEIKTTTPAPRPPTPAPTIASQPL SLRPEACRPAAGGAVHTRGLDFACDIYIWAPLAGTCGVLLLSLVITLY CKRGRKKLLYIFKQPFMRPVQTTQEEDGCSCRFPEEEEGGCELRVKFS RSADAPAYKQGQNQLYNELNLGRREEYDVLDKRRGRDPEMGGKPRRKN PQEGLYNELQKDKMAEAYSEIGMKGERRRGKGHDGLYQGLSTATKDTY DALHMQALPPR | |
| CD19 | CAR 12 | MALPVTALLLPLALLLHAARPEIVMTQSPATLSLSPGERATLSCRASQ DISKYLNWYQQKPGQAPRLLIYHTSRLHSGIPARFSGSGSGTDYTLTI SSLQPEDFAVYFCQQGNTLPYTFGQGTKLEIKGGGGSGGGGSGGGGSQ VQLQESGPGLVKPSETLSLTCTVSGVSLPDYGVSWIRQPPGKGLEWIG VIWGSETTYYNSSLKSRVTISKDNSKNQVSLKLSSVTAADTAVYYCAK HYYYGGSYAMDYWGQGTLVTVSSTTTPAPRPPTPAPTIASQPLSLRPE ACRPAAGGAVHTRGLDFACDIYIWAPLAGTCGVLLLSLVITLYCKRGR KKLLYIFKQPFMRPVQTTQEEDGCSCRFPEEEEGGCELRVKFSRSADA PAYKQGQNQLYNELNLGRREEYDVLDKRRGRDPEMGGKPRRKNPQEGL YNELQKDKMAEAYSEIGMKGERRRGKGHDGLYQGLSTATKDTYDALHM QALPPR | 7919 |

In one embodiment, the CAR molecule comprises (e.g., consists of) an amino acid sequence as provided in Table 22, or in Table 3 of International Publication No. WO2014/153270, filed Mar. 15, 2014; incorporated herein by reference. In one embodiment, the CAR molecule comprises (e.g., consists of) an amino acid sequence of SEQ ID NO: 7908, SEQ ID NO: 7909, SEQ ID NO: 7910, SEQ ID NO: 7911, SEQ ID NO: 7912, SEQ ID NO: 7913, SEQ ID NO: 7914, SEQ ID NO: 7915, SEQ ID NO: 7916, SEQ ID NO: 7917, SEQ ID NO: 7918, SEQ ID NO: 7919, or SEQ ID NO: 7920; or an amino acid sequence having at least one, two, three, four, five, 10, 15, 20 or 30 modifications (e.g., substitutions, e.g., conservative substitutions) but not more than 60, 50, or 40 modifications (e.g., substitutions, e.g., conservative substitutions) of an amino acid sequence of SEQ ID NO: 7908, SEQ ID NO: 7909, SEQ ID NO: 7910, SEQ ID NO: 7911, SEQ ID NO: 7912, SEQ ID NO: 7913, SEQ ID NO: 7914, SEQ ID NO: 7915, SEQ ID NO: 7916, SEQ ID NO: 7917, SEQ ID NO: 7918, SEQ ID NO: 7919, or SEQ ID NO: 7920; or an amino acid sequence having 85%, 90%, 95%, 96%, 97%, 98%, 99% identity to an amino acid sequence of SEQ ID NO: 7908, SEQ ID NO: 7909, SEQ ID NO: 7910, SEQ ID NO: 7911, SEQ ID NO: 7912, SEQ ID NO: 7913, SEQ ID NO: 7914, SEQ ID NO: 7915, SEQ ID NO: 7916, SEQ ID NO: 7917, SEQ ID NO: 7918, SEQ ID NO: 7919, or SEQ ID NO: 7920.

In one aspect, a CAR, e.g., a CAR expressed by the cell of the invention, comprises a CAR molecule comprising an antigen binding domain that binds to BCMA, e.g., comprises a BCMA antigen binding domain (e.g., a murine, human or humanized antibody or antibody fragment that specifically binds to BCMA, e.g., human BCMA), a transmembrane domain, and an intracellular signaling domain (e.g., an intracellular signaling domain comprising a costimulatory domain and/or a primary signaling domain).

Exemplary CAR molecules of a CAR described herein are provided in Table 23, or Table 1 of WO2016/014565, or as otherwise described herein. The CAR molecules in Table 23 comprise a BCMA antigen binding domain, e.g., an amino acid sequence of any BCMA antigen binding domain provided in Table 18 or 19.

TABLE 23

Exemplary BCMA CAR molecules. Sequences are provided with a leader sequence.

| Name/ Description | SEQ ID NO: | Sequence |
|---|---|---|
| 139109 | | |
| 139109-aa Full CAR | 8559 | MALPVTALLLPLALLLHAARPEVQLVESGGGLVQPGGSLRLSCAVSGFALS NHGMSWVRRAPGKGLEWVSGIVYSGSTYYAASVKGRFTISRDNSRNTLYLQ MNSLRPEDTAIYYCSAHGGESDVWGQGTTVTVSSASGGGGSGGRASGGGGS DIQLTQSPSSLSASVGDRVTITCRASQSISSYLNWYQQKPGKAPKLLIYAA SSLQSGVPSRFSGSGSGTDFTLTISSLQPEDFATYYCQQSYSTPYTFGQGT KVEIKTTTPAPRPPTPAPTIASQPLSLRPEACRPAAGGAVHTRGLDFACDI YIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDK RRGRDPEMGGKPRRKNPQEGLYNELQKDKMAEAYSEIGMKGERRRGKGHDG LYQGLSTATKDTYDALHMQALPPR |
| 139109-nt Full CAR | 8574 | ATGGCCCTCCCTGTCACCGCCCTGCTGCTTCCGCTGGCTCTTCTGCTCCAC GCCGCTCGGCCCGAAGTGCAATTGGTGGAATCAGGGGGAGGACTTGTGCAG CCTGGAGGATCGCTGAGACTGTCATGTGCCGTGTCCGGCTTTGCCCTGTCC AACCACGGGATGTCCTGGGTCCGCCGCGCGCCTGGAAAGGGCCTCGAATGG GTGTCGGGTATTGTGTACAGCGGTAGCACCTACTATGCCGCATCCGTGAAG |

TABLE 23-continued

Exemplary BCMA CAR molecules. Sequences are provided with a leader sequence.

| Name/<br>Description | SEQ ID<br>NO: | Sequence |
|---|---|---|
| | | GGGAGATTCACCATCAGCCGGGACAACTCCAGGAACACTCTGTACCTCCAA<br>ATGAATTCGCTGAGGCCAGAGGACACTGCCATCTACTACTGCTCCGCGCAT<br>GGCGGAGAGTCCGACGTCTGGGGACAGGGGACCACCGTGACCGTGTCTAGC<br>GCGTCCGGCGGAGGCGGCAGCGGGGGTCGGGCATCAGGGGCGGCGGATCG<br>GACATCCAGCTCACCCAGTCCCCGAGCTCGCTGTCCGCCTCCGTGGGAGAT<br>CGGGTCACCATCACGTGCCGCGCCAGCCAGTCGATTTCCTCCTACCTGAAC<br>TGGTACCAACAGAAGCCCGGAAAAGCCCCGAAGCTTCTCATCTACGCCGCC<br>TCGAGCCTGCAGTCAGGAGTGCCCTCACGGTTCTCCGGCTCCGGTTCCGGT<br>ACTGATTTCACCCTGACCATTTCCTCCCTGCAACCGGAGGACTTCGCTACT<br>TACTACTGCCAGCAGTCGTACTCCACCCCCTACACTTTCGGACAAGGCACC<br>AAGGTCGAAATCAAGACCACTACCCCAGCACCGAGGCCACCCACCCCGGCT<br>CCTACCATCGCCTCCCAGCCTCTGTCCCTGCGTCCGGAGGCATGTAGACCC<br>GCAGCTGGTGGGGCCGTGCATACCCGGGGTCTTGACTTCGCCTGCGATATC<br>TACATTTGGGCCCCTCTGGCTGGTACTTGCGGGGTCCTGCTGCTTTCACTC<br>GTGATCACTCTTTACTGTAAGCGCGGTCGGAAGAAGCTGCTGTACATCTTT<br>AAGCAACCCTTCATGAGGCCTGTGCAGACTACTCAAGAGGAGGACGGCTGT<br>TCATGCCGGTTCCCAGAGGAGGAGGAAGGCGGCTGCGAACTGCGCGTGAAA<br>TTCAGCCGCAGCGCAGATGCTCCAGCCTACAAGCAGGGGCAGAACCAGCTC<br>TACAACGAACTCAATCTTGGTCGGAGAGAGGAGTACGACGTGCTGGACAAG<br>CGGAGAGGACGGGACCCAGAAATGGGCGGGAAGCCGCGCAGAAAGAATCCC<br>CAAGAGGGCCTGTACAACGAGCTCCAAAAGGATAAGATGGCAGAAGCCTAT<br>AGCGAGATTGGTATGAAAGGGGAACGCAGAAGAGGCAAAGGCCACGACGGA<br>CTGTACCAGGGACTCAGCACCGCCACCAAGGACACCTATGACGCTCTTCAC<br>ATGCAGGCCCTGCCGCCTCGG |
| 139103 | | |
| 139103-aa<br>Full CAR | 8549 | MALPVTALLLPLALLLHAARPQVQLVESGGGLVQPGRSLRLSCAASGFTFS<br>NYAMSWVRQAPGKGLGWVSGISRSGENTYYADSVKGRFTISRDNSKNTLYL<br>QMNSLRDEDTAVYYCARSPAHYYGGMDVWGQGTTVTVSSASGGGGSGGRAS<br>GGGGSDIVLTQSPGTLSLSPGERATLSCRASQSISSSFLAWYQQKPGQAPR<br>LLIYGASRRATGIPDRFSGSGSGTDFTLTISRLEPEDSAVYYCQQYHSSPS<br>WTFGQGTKLEIKTTTPAPRPPTPAPTIASQPLSLRPEACRPAAGGAVHTRG<br>LDFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRRE<br>EYDVLDKRRGRDPEMGGKPRRKNPQEGLYNELQKDKMAEAYSEIGMKGERR<br>RGKGHDGLYQGLSTATKDTYDALHMQALPPR |
| 139103-nt<br>Full CAR | 8564 | ATGGCCCTCCCTGTCACCGCCCTGCTGCTTCCGCTGGCTCTTCTGCTCCAC<br>GCCGCTCGGCCCCAAGTGCAACTCGTGGAATCTGGTGGAGGACTCGTGCAA<br>CCCGGAAGATCGCTTAGACTGTCGTGTGCCGCCAGCGGGTTCACTTTCTCG<br>AACTACGCGATGTCCTGGGTCCGCCAGGCACCCGGAAAGGGACTCGGTTGG<br>GTGTCCGGCATTTCCCGGTCCGGCGAAAATACCTACTACGCCGACTCCGTG<br>AAGGGCCGCTTCACCATCTCAAGGGACAACAGCAAAAACACCCTGTACTTG<br>CAAATGAACTCCCTGCGGGATGAAGATACAGCCGTGTACTATTGCGCCCGG<br>TCGCCTGCCCATTACTACGGCGGAATGGACGTCTGGGGACAGGGAACCACT<br>GTGACTGTCAGCAGCGCGTCGGGTGGCGGCGGCTCAGGGGGTCGGGCCTCC<br>GGGGGGGGAGGGTCCGACATCGTGCTGACCCAGTCCCCGGGAACCCTGAGC<br>CTGAGCCCGGGAGAGCGCGCGACCCTGTCATGCCGGGCATCCCAGAGCATT<br>AGCTCCTCCTTTCTCGCCTGGTATCAGCAGAAGCCCGGACAGGCCCCGAGG<br>CTGCTGATCTACGGCGCTAGCAGAAGGGCTACCGGAATCCCAGACCGGTTC<br>TCCGGCTCCGGTTCCGGGACCGATTTCACCCTTACTATCTCGCGCCTGGAA<br>CCTGAGGACTCCGCCGTCTACTACTGCCAGCAGTACCACTCATCCCCGTCG<br>TGGACGTTCGGACAGGGCACCAAGCTGGAGATTAAGACCACTACCCCAGCA<br>CCGAGGCCACCCACCCCGGCTCCTACCATCGCCTCCCAGCCTCTGTCCCTG<br>CGTCCGGAGGCATGTAGACCCGCAGCTGGTGGGGCCGTGCATACCCGGGGT<br>CTTGACTTCGCCTGCGATATCTACATTTGGGCCCCTCTGGCTGGTACTTGC<br>GGGGTCCTGCTGCTTTCACTCGTGATCACTCTTTACTGTAAGCGCGGTCGG<br>AAGAAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAAGGC<br>GGCTGCGAACTGCGCGTGAAATTCAGCCGCAGCGCAGATGCTCCAGCCTAC<br>AAGCAGGGGCAGAACCAGCTCTACAACGAACTCAATCTTGGTCGGAGAGAG<br>GAGTACGACGTGCTGGACAAGCGGAGAGGACGGGACCCAGAAATGGGCGGG<br>AAGCCGCGCAGAAAGAATCCCCAAGAGGGCCTGTACAACGAGCTCCAAAAG<br>GATAAGATGGCAGAAGCCTATAGCGAGATTGGTATGAAAGGGGAACGCAGA<br>AGAGGCAAAGGCCACGACGGACTGTACCAGGGACTCAGCACCGCCACCAAG<br>GACACCTATGACGCTCTTCACATGCAGGCCCTGCCGCCTCGG |
| 139105 | | |
| 139105-aa<br>Full CAR | 8550 | MALPVTALLLPLALLLHAARPQVQLVESGGGLVQPGRSLRLSCAASGFTFD<br>DYAMHWVRQAPGKGLEWVSGISWNSGSIGYADSVKGRFTISRDNAKNSLYL<br>QMNSLRAEDTALYYCSVHSFPLAYWGQGTLVTVSSASGGGGSGGRASGGGGS<br>DIVMTQTPLSLPVTPGEPASISCRSSQSLLHSNGYNYLDWYLQKPGQSPQL<br>LIYLGSNRASGVPDRFSGSGSGTDFTLKISRVEAEDVGVYYCMQALQTPYT<br>FGQGTKVEIKTTTPAPRPPTPAPTIASQPLSLRPEACRPAAGGAVHTRGLD |

TABLE 23-continued

Exemplary BCMA CAR molecules. Sequences are provided with a leader sequence.

| Name/<br>Description | SEQ ID<br>NO: | Sequence |
|---|---|---|
| | | FACDIYIWAPLAGTCGVLLLSLVITLYCKRGRKKLLYIFKQPFMRPVQTTQ<br>EEDGCSCRFPEEEEGGCELRVKFSRSADAPAYKQGQNQLYNELNLGRREEY<br>DVLDKRRGRDPEMGGKPRRKNPQEGLYNELQKDKMAEAYSEIGMKGERRRG<br>KGHDGLYQGLSTATKDTYDALHMQALPPR |
| 139105-nt<br>Full CAR | 8565 | ATGGCCCTCCCTGTCACCGCCCTGCTGCTTCCGCTGGCTCTTCTGCTCCAC<br>GCCGCTCGGCCCAAGTGCAACTCGTCGAATCCGGTGGAGGTCTGGTCCAA<br>CCTGGTAGAAGCCTGAGACTGTCGTGTGCGGCCAGCGGATTCACCTTTGAT<br>GACTATGCTATGCACTGGGTGCGGCAGGCCCCAGGAAAGGGCCTGGAATGG<br>GTGTCGGGAATTAGCTGGAACTCCGGGTCCATTGGCTACGCCGACTCCGTG<br>AAGGGCCGCTTCACCATCTCCCGCGACAACGCAAAGAACTCCCTGTACTTG<br>CAAATGAACTCGCTCAGGGCTGAGGATACCGCGCTGTACTACTGCTCCGTG<br>CATTCCTTCCTGGCCTACTGGGGACAGGGAACTCTGGTCACCGTGTCGAGC<br>GCCTCCGGCGGCGGGGGCTCGGGTGGACGGGCCTCGGGCGGAGGGGGGTCC<br>GACATCGTGATGACCCAGACCCCGCTGAGCTTGCCCGTGACTCCCGGAGAG<br>CCTGCATCCATCTCCTGCCGGTCATCCCAGTCCCTTCTCCACTCCAACGGA<br>TACAACTACCTCGACTGGTACCTCCAGAAGCCGGGACAGAGCCCTCAGCTT<br>CTGATCTACCTGGGGTCAAATAGAGCCTCAGGAGTGCCGGATCGGTTCAGC<br>GGATCTGGTTCGGGAACTGATTTCACTCTGAAGATTTCCCGCGTGGAAGCC<br>GAGGACGTGGGCGTCTACTACTGTATGCAGGCGCTGCAGACCCCTATACC<br>TTCGGCCAAGGGACGAAAGTGGAGATCAAGACCACTACCCCAGCACCGAGG<br>CCACCCACCCCGGCTCCTACCATCGCCTCCCAGCCTCTGTCCCTGCGTCCG<br>GAGGCATGTAGACCCGCAGCTGGTGGGCCGTGCATACCCGGGGTCTTGAC<br>TTCGCCTGCGATATCTACATTTGGGCCCCTCTGGCTGGTACTTGCGGGGTC<br>CTGCTGCTTTCACTCGTGATCACTCTTTACTGTAAGCGCGGTCGGAAGAAG<br>CTGCTGTACATCTTTAAGCAACCCTTCATGAGGCCTGTGCAGACTACTCAA<br>GAGGAGGACGGCTGTTCATGCCGGTTCCCAGAGGAGGAGGAAGGCGGCTGC<br>GAACTGCGCGTGAAATTCAGCCGCAGCGCAGATGCTCCAGCCTACAAGCAG<br>GGGCAGAACCAGCTCTACAACGAACTCAATCTTGGTCGGAGAGAGGAGTAC<br>GACGTGCTGGACAAGCGGAGAGGACGGGACCCAGAAATGGGCGGGAAGCCG<br>CGCAGAAAGAATCCCCAAGAGGGCCTGTACAACGAGCTCCAAAAGGATAAG<br>ATGGCAGAAGCCTATAGCGAGATTGGTATGAAAGGGGAACGCAGAAGAGGC<br>AAAGGCCACGACGGACTGTACCAGGGACTCAGCACCGCCACCAAGGACACC<br>TATGACGCTCTTCACATGCAGGCCCTGCCGCCTCGG |

139111

| 139111-aa<br>Full CAR | 8551 | MALPVTALLLPLALLLHAARPEVQLLESGGGLVQPGGSLRLSCAVSGFALS<br>NHGMSWVRRAPGKGLEWVSGIVYSGSTYYAASVKGRFTISRDNSRNTLYLQ<br>MNSLRPEDTAIYYCSAHGGESDVWGQGTTVTVSSASGGGGSGGRASGGGGS<br>DIVMTQTPLSLSVTPGQPASISCKSSQSLLRNDGKTPLYWYLQKAGQPPQL<br>LIYEVSNRFSGVPDRFSGSGSGTDFTLKISRVEAEDVGAYYCMQNIQFPSF<br>GGGTKLEIKTTTPAPRPPTPAPTIASQPLSLRPEACRPAAGGAVHTRGLDF<br>ACDIYIWAPLAGTCGVLLLSLVITLYCKRGRKKLLYIFKQPFMRPVQTTQE<br>EDGCSCRFPEEEEGGCELRVKFSRSADAPAYKQGQNQLYNELNLGRREEYD<br>VLDKRRGRDPEMGGKPRRKNPQEGLYNELQKDKMAEAYSEIGMKGERRRGK<br>GHDGLYQGLSTATKDTYDALHMQALPPR |
| 139111-nt<br>Full CAR | 8566 | ATGGCCCTCCCTGTCACCGCCCTGCTGCTTCCGCTGGCTCTTCTGCTCCAC<br>GCCGCTCGGCCCGAAGTGCAATTGTTGGAATCTGGAGGAGGACTTGTGCAG<br>CCTGGAGGATCACTGAGACTTTCGTGTGCGGTGTCAGGCTTCGCCGTGAGC<br>AACCACGGCATGAGCTGGGTGCGGAGAGCCCCGGGGAAGGGTCTGGAATGG<br>GTGTCCGGGATCGTCTACTCCGGTTCAACTTACTACGCCGCAAGCGTGAAG<br>GGTCGCTTCACCATTTCCCGCGATAACTCCCGGAACACCCTGTACCTCCAA<br>ATGAACTCCCTGCGGCCCGAGGACACCGCCATCTACTACTGTTCCGCGCAT<br>GGAGGAGAGTCCGATGTCTGGGGACAGGGCACTACCGTGACCGTGTCGAGC<br>GCCTCGGGGGGAGGAGGCTCCGGCGGTCGCGCCTCCGGGGGGGTGGCAGC<br>GACATTGTGATGACGCAGACTCCACTCTCGCTGTCCGTGACCCCGGGACAG<br>CCCGCGTCCATCTCGTGCAAGAGCTCCCAGAGCCTGCTGAGGAACGACGGA<br>AAGACTCCTCTGTATTGGTACCTCCAGAAGGCTGGACAGCCCCCGCAACTG<br>CTCATCTACGAAGTGTCAAATCGCTTCTCCGGGGTGCCGGATCGGTTTTCC<br>GGCTCGGGATCGGCACCGACTTCACCCTGAAAATCTCCAGGGTCGAGGCC<br>GAGGACGTGGGAGCCTACTACTGCATGCAAAACATCCAGTTCCCTTCCTTC<br>GGCGGCGGCACAAAGCTGGAGATTAAGACCACTACCCCAGCACCGAGGCCA<br>CCCACCCCGGCTCCTACCATCGCCTCCCAGCCTCTGTCCCTGCGTCCGGAG<br>GCATGTAGACCCGCAGCTGGTGGGCCGTGCATACCCGGGGTCTTGACTTC<br>GCCTGCGATATCTACATTTGGGCCCCTCTGGCTGGTACTTGCGGGGTCCTG<br>CTGCTTTCACTCGTGATCACTCTTTACTGTAAGCGCGGTCGGAAGAAGCTG<br>CTGTACATCTTTAAGCAACCCTTCATGAGGCCTGTGCAGACTACTCAAGAG<br>GAGGACGGCTGTTCATGCCGGTTCCCAGAGGAGGAGGAAGGCGGCTGCGAA<br>CTGCGCGTGAAATTCAGCCGCAGCGCAGATGCTCCAGCCTACAAGCAGGGG<br>CAGAACCAGCTCTACAACGAACTCAATCTTGGTCGGAGAGAGGAGTACGAC<br>GTGCTGGACAAGCGGAGAGGACGGGACCCAGAAATGGGCGGGAAGCCGCGC<br>AGAAAGAATCCCCAAGAGGGCCTGTACAACGAGCTCCAAAAGGATAAGATG<br>GCAGAAGCCTATAGCGAGATTGGTATGAAAGGGGAACGCAGAAGAGGCAAA<br>GGCCACGACGGACTGTACCAGGGACTCAGCACCGCCACCAAGGACACCTAT<br>GACGCTCTTCACATGCAGGCCCTGCCGCCTCGG |

TABLE 23-continued

Exemplary BCMA CAR molecules. Sequences are provided with a leader sequence.

| Name/Description | SEQ ID NO: | Sequence |
|---|---|---|
| 139100 | | |
| 139100-aa Full CAR | 8552 | MALPVTALLLPLALLLHAARPQVQLVQSGAEVRKTGASVKVSCKASGYIFD NEGINWVRQAPGQGLEWMGWINPKNNNTNYAQKFQGRVTITADESTNTAYM EVSSLRSEDTAVYYCARGPYYYQSYMDVWGQGTMVTVSSASGGGGSGGRAS GGGGSDIVMTQTPLSLPVTPGEPASISCRSSQSLLHSNGYNYLNWYLQKPG QSPQLLIYLGSKRASGVPDRFSGSGSGTDFTLHITRVGAEDVGVYYCMQAL QTPYTFGQGTKLEIKTTTPAPRPPTPAPTIASQPLSLRPEACRPAAGGAVH TRGLDFACDIYIWAPLAGTCGVLLLSLVITLYCKRGRKKLLYIFKQPFMRP VQTTQEEDGCSCRFPEEEEGGCELRVKFSRSADAPAYKQGQNQLYNELNLG RREEYDVLDKRRGRDPEMGGKPRRKNPQEGLYNELQKDKMAEAYSEIGMKG ERRRGKGHDGLYQGLSTATKDTYDALHMQALPPR |
| 139100-nt Full CAR | 8567 | ATGGCCCTCCCTGTCACCGCCCTGCTGCTTCCGCTGGCTCTTCTGCTCCAC GCCGCTCGGCCCCAAGTCCAACTCGTCCAGTCCGGCGCAGAAGTCAGAAAA ACCGGTGCTAGCGTGAAAGTGTCCTGCAAGGCCTCCGGCTACATTTTCGAT AACTTCGGAATCAACTGGGTCAGACAGGCCCCGGGCCAGGGGCTGGAATGG ATGGGATGGATCAACCCCAAGAACAACAACACCAACTACGCACAGAAGTTC CAGGGCCGCGTGACTATCACCGCCGATGAATCGACCAATACCGCCTACATG GAGGTGTCCTCCCTGCGGTCGGAGGACACTGCCGTGTATTACTGCGCGAGG GGCCCATACTACTACCAAAGCTACATGGACGTCTGGGGACAGGGAACCATG GTGACCGTGTCATCCGCCTCCGGTGGTGGAGGCTCCGGGGGCGGGCTTCA GGAGGCGGAGGAAGCGATATTGTGATGACCCAGACTCCGCTTAGCCTGCCC GTGACTCCTGGAGAACCGGCCTCCATTTCCTGCCGGTCCTCGCAATCACTC CTGCATTCCAACGGTTACAACTACCTGAATTGGTACCTCCAGAAGCCTGGC CAGTCGCCCCAGTTGCTGATCTATCTGGGCTCGAAGCGCGCCTCCGGGGTG CCTGACCGGTTTAGCGGATCTGGGAGCGGCACGGACTTCACTCTCCACATC ACCCGCGTGGGAGCGGAGGACGTGGGAGTGTACTACTGTATGCAGGCGCTG CAGACTCCGTACACATTCGGACAGGGCACCAAGCTGGAGATCAAGACCACT ACCCCAGCACCGAGGCCACCCACCCCGGCTCCTACCATCGCCTCCCAGCCT CTGTCCCTGCGTCGGAGGCATGTAGACCCGCAGCTGGTGGGGCCGTGCAT ACCCGGGGTCTTGACTTCGCCTGCGATATCTACATTTGGGCCCCTCTGGCT GGTACTTGCGGGGTCCTGCTGCTTTCACTCGTGATCACTCTTTACTGTAAG CGCGGTCGGAAGAAGCTGCTGTACATCTTTAAGCAACCCTTCATGAGGCCT GTGCAGACTACTCAAGAGGAGGACGGCTGTTCATGCCGGTTCCCAGAGGAG GAGGAAGGCGGCTGCGAACTGCGCGTGAAATTCAGCCGCAGCGCAGATGCT CCAGCCTACAAGCAGGGGCAGAACCAGCTCTACAACGAACTCAATCTTGGT CGGAGAGAGGAGTACGACGTGCTGGACAAGCGGAGAGGACGGGACCCAGAA ATGGGCGGGAAGCCGCGCAGAAAGAATCCCCAAGAGGGCCTGTACAACGAG CTCCAAAAGGATAAGATGGCAGAAGCCTATAGCGAGATTGGTATGAAAGGG GAACGCAGAAGAGGCAAAGGCCACGACGGACTGTACCAGGGACTCAGCACC GCCACCAAGGACACCTATGACGCTCTTCACATGCAGGCCCTGCCGCCTCGG |
| 139101 | | |
| 139101-aa Full CAR | 8553 | MALPVTALLLPLALLLHAARPQVQLQESGGGLVQPGGSLRLSCAASGFTFS SDAMTWVRQAPGKGLEWVSVISGSGGTTYYADSVKGRFTISRDNSKNTLYL QMNSLRAEDTAVYYCAKLDSSGYYYARGPRYWGQGTLVTVSSASGGGGSGG RASGGGGSDIQLTQSPSSLSASVGDRVTITCRASQSISSYLNWYQQKPGKA PKLLIYGASTLASGVPARFSGSGSGTHFTLTINSLQSEDSATYYCQQSYKR ASFGQGTKVEIKTTTPAPRPPTPAPTIASQPLSLRPEACRPAAGGAVHTRG LDFACDIYIWAPLAGTCGVLLLSLVITLYCKRGRKKLLYIFKQPFMRPVQT TQEEDGCSCRFPEEEEGGCELRVKFSRSADAPAYKQGQNQLYNELNLGRRE EYDVLDKRRGRDPEMGGKPRRKNPQEGLYNELQKDKMAEAYSEIGMKGERR RGKGHDGLYQGLSTATKDTYDALHMQALPPR |
| 139101-nt Full CAR | 8568 | ATGGCCCTCCCTGTCACCGCCCTGCTGCTTCCGCTGGCTCTTCTGCTCCAC GCCGCTCGGCCCCAAGTGCAACTTCAAGAATCAGGCGGAGGACTCGTGCAG CCCGGAGGATCATTGCGGCTCTCGTGCGCCGCCTCGGGCTTCACCTTCTCG AGCGACGCCATGACCTGGGTCCGCCAGGCCCGGGGAAGGGGCTGGAATGG GTGTCTGTGATTTCCGGCTCCGGGGGAACTACTACTACGCCGATTCCGTG AAAGGTCGCTTCACTATCTCCCGGGACAACAGCAAGAACACCCTTTATCTG CAAATGAATTCCCTGCGCGCCGAGGACACCGCCGTGTACTACTGCGCCAAG CTGGACTCCTCGGGCTACTACTATGCCCGGGGTCCGAGATACTGGGGACAG GGAACCCTCGTGACCGTGTCCTCCGCGTCCGGCGGAGGAGGGTCGGAGGG CGGGCCTCCGGCGGCGGCGGTTCGGACATCCAGCTGACCCAGTCCCCATCC TCACTGAGCGCAAGCGTGGGCGACAGAGTCACCATTACATGCAGGGCGTCC CAGAGCATCAGCTCCTACCTGAACTGGTACCAACAGAAGCCTGGAAAGGCT CCTAAGCTGTTGATCTACGGGGCTTGACCCTGGCATCCGGGGTGCCCGCG AGGTTTAGCGGAAGCGGTAGCGGCACTCACTTCACTCTGACCATTAACAGC CTCCAGTCCGAGGATTCAGCCACTTACTACTGTCAGCAGTCCTACAAGCGG GCCAGCTTCGGACAGGGCACTAAGGTCGAGATCAAGACCACTACCCCAGCA CCGAGGCCACCCACCCCGGCTCCTACCATCGCCTCCCAGCCTCTGTCCCTG CGTCCGGAGGCATGTAGACCCGCAGCTGGTGGGGCCGTGCATACCCGGGGT CTTGACTTCGCCTGCGATATCTACATTTGGGCCCCTCTGGCTGGTACTTGC GGGGTCCTGCTGCTTTCACTCGTGATCACTCTTTACTGTAAGCGCGGTCGG |

TABLE 23-continued

Exemplary BCMA CAR molecules. Sequences are provided with a leader sequence.

| Name/<br>Description | SEQ ID<br>NO: | Sequence |
|---|---|---|
| | | AAGAAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAAGGC<br>GGCTGCGAACTGCGCGTGAAATTCAGCCGCAGCGCAGATGCTCCAGCCTAC<br>AAGCAGGGGCAGAACCAGCTCTACAACGAACTCAATCTTGGTCGGAGAGAG<br>GAGTACGACGTGCTGGACAAGCGGAGAGGACGGGACCCAGAAATGGGCGGG<br>AAGCCGCGCAGAAAGAATCCCCAAGAGGGCCTGTACAACGAGCTCCAAAAG<br>GATAAGATGGCAGAAGCCTATAGCGAGATTGGTATGAAAGGGGAACGCAGA<br>AGAGGCAAAGGCCACGACGGACTGTACCAGGGACTCAGCACCGCCACCAAG<br>GACACCTATGACGCTCTTCACATGCAGGCCCTGCCGCCTCGG |
| 139102 | | |
| 139102-aa<br>Full CAR | 8554 | MALPVTALLLPLALLLHAARPQVQLVQSGAEVKKPGASVKVSCKASGYTFS<br>NYGITWVRQAPGQGLEWMGWISAYNGNTNYAQKFQGRVTMTRNTSISTAYM<br>ELSSLRSEDTAVYYCARGPYYYYMDVWGKGTMVTVSSASGGGGSGGRASGG<br>GGSEIVMTQSPLSLPVTPGEPASISCRSSQSLLYSNGYNYVDWYLQKPGQS<br>PQLLIYLGSNRASGVPDRFSGSGSGTDFKLQISRVEAEDVGIYYCMQGRQF<br>PYSFGQGTKVEIKTTTPAPRPPTPAPTIASQPLSLRPEACRPAAGGAVHTR<br>GLDFACDIYIWAPLAGTCGVLLLSLVITLYCKRGRKKLLYIFKQPFMRPVQ<br>TTQEEDGCSCRFPEEEEGGCELRVKFSRSADAPAYKQGQNQLYNELNLGRR<br>EEYDVLDKRRGRDPEMGGKPRRKNPQEGLYNELQKDKMAEAYSEIGMKGER<br>RRGKGHDGLYQGLSTATKDTYDALHMQALPPR |
| 139102-nt<br>Full CAR | 8569 | ATGGCCCTCCCTGTCACCGCCCTGCTGCTTCCGCTGGCTCTTCTGCTCCAC<br>GCCGCTCGGCCCCAAGTCCAACTGGTCCAGAGCGGTGCAGAAGTGAAGAAG<br>CCCGGAGCGAGCGTGAAAGTGTCCTGCAAGGCTTCCGGGTACACCTTCTCC<br>AACTACGGCATCACTTGGGTGCGCCAGGCCCCGGGACAGGGCCTGGAATGG<br>ATGGGGTGGATTTCCGCGTACAACGGCAATACGAACTACGCTCAGAAGTTC<br>CAGGGTAGAGTGACCATGACTAGGAACACCTCCATTTCCACCGCCTACATG<br>GAACTGTCCTCCCTGCGGAGCGAGGACACCGCCGTGTACTATTGCGCCCGG<br>GGACCATACTACTACTACATGGATGTCTGGGGGAAGGGGACTATGGTCACC<br>GTGTCATCCGCCTCGGGAGGCGGCGGATCAGGAGGACGCGCCTCTGGTGGT<br>GGAGGATCGGAGATCGTGATGACCCAGAGCCCTCTCTCCTTGCCCGTGACT<br>CCTGGGGAGCCCGCATCCATTTCATGCCGGAGCTCCAGTCACTTCTCTAC<br>TCCAACGGCTATAACTACGTGGATTGGTACCTCCAAAAGCCGGGCCAGAGC<br>CCGCAGCTGCTGATCTACCTGGGCTCGAACAGGGCCAGCGGAGTGCCTGAC<br>CGGTTCTCCGGGTCGGGAAGCGGGACCGACTTCAAGCTGCAAATCTCGAGA<br>GTGGAGGCCGAGGACGTGGGAATCTACTACTGTATGCAGGGCCGCCAGTTT<br>CCGTACTCGTTCGGACAGGGCACCAAAGTGGAAATCAAGACCACTACCCCA<br>GCACCGAGGCCACCCACCCCGGCTCCTACCATCGCCTCCCAGCCTCTGTCC<br>CTGCGTCCGGAGGCATGTAGACCCGCAGCTGGTGGGGCCGTGCATACCCGG<br>GGTCTTGACTTCGCCTGCGATATCTACATTTGGGCCCCTCTGGCTGGTACT<br>TGCGGGGTCCTGCTGCTTTCACTCGTGATCACTCTTTACTGTAAGCGCGGT<br>CGGAAGAAGCTGCTGTACATCTTTAAGCAACCCTTCATGAGGCCTGTGCAG<br>ACTACTCAAGAGGAGGACGGCTGTTCATGCCGGTTCCCAGAGGAGGAGGAA<br>GGCGGCTGCGAACTGCGCGTGAAATTCAGCCGCAGCGCAGATGCTCCAGCC<br>TACAAGCAGGGGCAGAACCAGCTCTACAACGAACTCAATCTTGGTCGGAGA<br>GAGGAGTACGACGTGCTGGACAAGCGGAGAGGACGGGACCCAGAAATGGGC<br>GGGAAGCCGCGCAGAAAGAATCCCCAAGAGGGCCTGTACAACGAGCTCCAA<br>AAGGATAAGATGGCAGAAGCCTATAGCGAGATTGGTATGAAAGGGGAACGC<br>AGAAGAGGCAAAGGCCACGACGGACTGTACCAGGGACTCAGCACCGCCACC<br>AAGGACACCTATGACGCTCTTCACATGCAGGCCCTGCCGCCTCGG |
| 139104 | | |
| 139104-aa<br>Full CAR | 8555 | MALPVTALLLPLALLLHAARPEVQLLETGGGLVQPGGSLRLSCAVSGFALS<br>NHGMSWVRRAPGKGLEWVSGIVYSGSTYYAASVKGRFTISRDNSRNTLYLQ<br>MNSLRPEDTAIYYCSAHGGESDVWGQGTTVTVSSASGGGGSGGRASGGGGS<br>EIVLTQSPATLSVSPGESATLSCRASQSVSSNLAWYQQKPGQAPRLLIYGA<br>STRASGIPDRFSGSGSGTDFTLTISSLQAEDVAVYYCQQYGSSLTFGGGTK<br>VEIKTTTPAPRPPTPAPTIASQPLSLRPEACRPAAGGAVHTRGLDFACDIY<br>IWAPLAGTCGVLLLSLVITLYCKRGRKKLLYIFKQPFMRPVQTTQEEDGCS<br>CRFPEEEEGGCELRVKFSRSADAPAYKQGQNQLYNELNLGRREEYDVLDKR<br>RGRDPEMGGKPRRKNPQEGLYNELQKDKMAEAYSEIGMKGERRRGKGHDGL<br>YQGLSTATKDTYDALHMQALPPR |
| 139104-nt<br>Full CAR | 8570 | ATGGCCCTCCCTGTCACCGCCCTGCTGCTTCCGCTGGCTCTTCTGCTCCAC<br>GCCGCTCGGCCCGAAGTGCAATTGCTCGAAACTGGAGGAGGTCTGGTGCAA<br>CCTGGAGGATCACTTCGCCTGTCCTGCGCCGTGTCGGGCTTTGCCCTGTCC<br>AACCATGGAATGAGCTGGGTCCGCCGCGCGCCGGGGAAGGGCCTCGAATGG<br>GTGTCCGGCATCGTCTACTCCGGCTCCACCTACTACGCCGCGTCCGTGAAG<br>GGCCGGTTCACGATTTCACGGGACAACTCGCGGAACACCCTGTACCTCCAA<br>ATGAATTCCCTTCGGCCGGAGGATACTGCCATCTACTACTGCTCCGCCCAC<br>GGTGGCGAATCCGACGTCTGGGGCCAGGGAACCACCGTGACCGTGTCCAGC<br>GCGTCCGGGGAGGAGGAAGCGGGGGTAGAGCATCGGGTGGAGGCGGATCA<br>GAGATCGTGCTGACCCAGTCCCCCGCCACCCTTGAGCGTGTCACCAGGAGAG<br>TCCGCCACCCTGTCATGCCGCGCCAGCCAGTCCGTGTCCTCCAACCTGGCT

TABLE 23-continued

Exemplary BCMA CAR molecules. Sequences are provided with a leader sequence.

| Name/<br>Description | SEQ ID<br>NO: | Sequence |
|---|---|---|
| | | TGGTACCAGCAGAAGCCGGGGCAGGCCCCTAGACTCCTGATCTATGGGCG<br>TCGACCCGGGCATCTGGAATTCCCGATAGGTTCAGCGGATCGGGCTCGGGC<br>ACTGACTTCACTCTGACCATCTCCTCGCTGCAAGCCGAGGACGTGGCTGTG<br>TACTACTGTCAGCAGTACGGAAGCTCCCTGACTTTCGGTGGCGGGACCAAA<br>GTCGAGATTAAGACCACTACCCCAGCACCGAGGCCACCCACCCCGGCTCCT<br>ACCATCGCCTCCCAGCCTCTGTCCCTGCGTCCGGAGGCATGTAGACCCGCA<br>GCTGGTGGGGCCGTGCATACCCGGGGTCTTGACTTCGCCTGCGATATCTAC<br>ATTTGGGCCCCTCTGGCTGGTACTTGCGGGGTCCTGCTGCTTTCACTCGTG<br>ATCACTCTTTACTGTAAGCGCGGTCGGAAGAAGCTGCTGTACATCTTTAAG<br>CAACCCTTCATGAGGCCTGTGCAGACTACTCAAGAGGAGGACGGCTGTTCA<br>TGCCGGTTCCCAGAGGAGGAGGAAGGCGGCTGCGAACTGCGCGTGAAATTC<br>AGCCGCAGCGCAGATGCTCCAGCCTACAAGCAGGGGCAGAACCAGCTCTAC<br>AACGAACTCAATCTTGGTCGGAGAGAGGAGTACGACGTGCTGGACAAGCGG<br>AGAGGACGGGACCCAGAAATGGGCGGGAAGCCGCGCAGAAAGAATCCCCAA<br>GAGGGCCTGTACAACGAGCTCCAAAAGGATAAGATGGCAGAAGCCTATAGC<br>GAGATTGGTATGAAAGGGGAACGCAGAAGAGGCAAAGGCCACGACGGACTG<br>TACCAGGGACTCAGCACCGCCACCAAGGACACCTATGACGCTCTTCACATG<br>CAGGGCCCTGCCGCCTCGG |
| 139106 | | |
| 139106-aa<br>Full CAR | 8556 | MALPVTALLLPLALLLHAARPEVQLVETGGGLVQPGGSLRLSCAVSGFALS<br>NHGMSWVRRAPGKGLEWVSGIVYSGSTYYAASVKGRFTISRDNSRNTLYLQ<br>MNSLRPEDTAIYYCSAHGGESDVWQGTTVTVSSASGGGGSGGRASGGGGS<br>EIVMTQSPATLSVSPGERATLSCRASQSVSSKLAWYQQKPGQAPRLLMYGA<br>SIRATGIPDRFSGSGSGTEFTLTISSLEPEDFAVYYCQQYGSSSWTFGQGT<br>KVEIKTTTPAPRPPTPAPTIASQPLSLRPEACRPAAGGAVHTRGLDFACDI<br>YIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDK<br>RRGRDPEMGGKPRRKNPQEGLYNELQKDKMAEAYSEIGMKGERRRGKGHDG<br>LYQGLSTATKDTYDALHMQALPPR |
| 139106-nt<br>Full CAR | 8571 | ATGGCCCTCCCTGTCACCGCCCTGCTGCTTCCGCTGGCTCTTCTGCTCCAC<br>GCCGCTCGGCCCGAAGTGCAATTGGTGGAAACTGGAGGAGGACTTGTGCAA<br>CCTGGAGGATCATTGAGACTGAGCTGCGCAGTGTCGGGATTCGCCCTGAGC<br>AACCATGGAATGTCCTGGGTCAGAAGGGCCCCTGGAAAAGGCCTCGAATGG<br>GTGTCAGGGATCGTGTACTCCGGTTCCACTTACTACGCCGCCTCCGTGAAG<br>GGGCGCTTCACTATCTCACGGGATAACTCCCGCAATACCCTGTACCTCCAA<br>ATGAACAGCCTGCGGCCGGAGGATACCGCCATCTACTACTGTTCCGCCCAC<br>GGTGGAGAGTCTGACGTCTGGGGCCAGGGAACTACCGTGACCGTGTCCTCC<br>GCGTCCGGCGGTGGAGGGAGCGGCGGCCGCGCCAGCGGCGGCGGAGGCTCC<br>GAGATCGTGATGACCCAGAGCCCCGCTACTCTGTCGGTGTCGCCCGGAGAA<br>AGGGCGACCCTGTCCTGCCGGGCGTCGCAGTCCGTGAGCAGCAAGCTGGCT<br>TGGTACCAGCAGAAGCCGGGCCAGGCACCACGCCTGCTTATGTACGGTGCC<br>TCCATTCGGGCCACCGGAATCCCGGACCGGTTCTCGGGGTCGGGGTCCGGT<br>ACCGAGTTCACACTGACCATTTCCTCGCTCGAGCCCGAGGACTTTGCCGTC<br>TATTACTGCCAGCAGTACGGCTCCTCCTCATGGACGTTCGGCCAGGGGACC<br>AAGGTCGAAATCAAGACCACTACCCCAGCACCGAGGCCACCCACCCCGGCT<br>CCTACCATCGCCTCCCAGCCTCTGTCCCTGCGTCCGGAGGCATGTAGACCC<br>GCAGCTGGTGGGGCCGTGCATACCCGGGGTCTTGACTTCGCCTGCGATATC<br>TACATTTGGGCCCCTCTGGCTGGTACTTGCGGGGTCCTGCTGCTTTCACTC<br>GTGATCACTCTTTACTGTAAGCGCGGTCGGAAGAAGCTGCTGTACATCTTT<br>AAGCAACCCTTCATGAGGCCTGTGCAGACTACTCAAGAGGAGGACGGCTGT<br>TCATGCCGGTTCCCAGAGGAGGAGGAAGGCGGCTGCGAACTGCGCGTGAAA<br>TTCAGCCGCAGCGCAGATGCTCCAGCCTACAAGCAGGGGCAGAACCAGCTC<br>TACAACGAACTCAATCTTGGTCGGAGAGAGGAGTACGACGTGCTGGACAAG<br>CGGAGAGGACGGGACCCAGAAATGGGCGGGAAGCCGCGCAGAAAGAATCCC<br>CAAGAGGGCCTGTACAACGAGCTCCAAAAGGATAAGATGGCAGAAGCCTAT<br>AGCGAGATTGGTATGAAAGGGGAACGCAGAAGAGGCAAAGGCCACGACGGA<br>CTGTACCAGGGACTCAGCACCGCCACCAAGGACACCTATGACGCTCTTCAC<br>ATGCAGGGCCCTGCCGCCTCGG |
| 139107 | | |
| 139107-aa<br>Full CAR | 8557 | MALPVTALLLPLALLLHAARPEVQLVETGGGVVQPGGSLRLSCAVSGFALS<br>NHGMSWVRRAPGKGLEWVSGIVYSGSTYYAASVKGRFTISRDNSRNTLYLQ<br>MNSLRPEDTAIYYCSAHGGESDVWQGTTVTVSSASGGGGSGGRASGGGGS<br>EIVLTQSPGTLSLSPGERATLSCRASQSVGSTNLAWYQQKPGQAPRLLIYD<br>ASNRATGIPDRFSGGGSGTDFTLTISRLEPEDFAVYYCQQYGSSPPWTFGQ<br>GTKVEIKTTTPAPRPPTPAPTIASQPLSLRPEACRPAAGGAVHTRGLDFAC<br>DIYIWAPLAGTCGVLLLSLVITLYCKRGRKKLLYIFKQPFMRPVQTTQEED<br>GCSCRFPEEEEGGCELRVKFSRSADAPAYKQGQNQLYNELNLGRREEYDVL<br>DKRRGRDPEMGGKPRRKNPQEGLYNELQKDKMAEAYSEIGMKGERRRGKGH<br>DGLYQGLSTATKDTYDALHMQALPPR |
| 139107-nt<br>Full CAR | 8572 | ATGGCCCTCCCTGTCACCGCCCTGCTGCTTCCGCTGGCTCTTCTGCTCCAC<br>GCCGCTCGGCCCGAAGTGCAATTGGTGGAGACTGGAGGAGGAGTGGTGCAA |

TABLE 23-continued

Exemplary BCMA CAR molecules. Sequences are provided with a leader sequence.

| Name/Description | SEQ ID NO: | Sequence |
|---|---|---|
| | | CCTGGAGGAAGCCTGAGACTGTCATGCGCGGTGTCGGGCTTCGCCCTCTCC<br>AACCACGGAATGTCCTGGGTCCGCCGGGCCCTGGGAAAGGACTTGAATGG<br>GTGTCCGGCATCGTGTACTCGGGTTCCACCTACTACGCGGCCTCAGTGAAG<br>GGCCGGTTTACTATTAGCCGCGACAACTCCAGAAACACACTGTACCTCCAA<br>ATGAACTCGCTGCGGCCGGAAGATACCGCTATCTACTACTGCTCCGCCCAT<br>GGGGGAGAGTCGGACGTCTGGGGACAGGGCACCACTGTCACTGTGTCCAGC<br>GCTTCCGGCGGTGGTGGAAGCGGGGGACGGGCCTCAGGAGGCGGTGGCAGC<br>GAGATTGTGCTGACCCAGTCCCCCGGGACCCTGAGCCTGTCCCCGGGAGAA<br>AGGGCCACCCTCTCCTGTCGGGCATCCCAGTCCGTGGGGTCTACTAACCTT<br>GCATGGTACCAGCAGAAGCCCGGCCAGGCCCCTCGCCTGCTGATCTACGAC<br>GCGTCCAATAGAGCCACCGGCATCCCGGATCGCTTCAGCGGAGGCGGATCG<br>GGCACCGACTTCACCCTCACCATTTCAAGGCTGGAACCGGAGGACTTCGCC<br>GTGTACTACTGCCAGCAGTATGGTTCGTCCCCACCCTGGACGTTCGGCCAG<br>GGGACTAAGGTCGAGATCAAGACCACTACCCCAGCACCGAGGCCACCCACC<br>CCGGCTCCTACCATCGCCTCCCAGCCTCTGTCCCTGCGTCCGGAGGCATGT<br>AGACCCGCAGCTGGTGGGGCCGTGCATACCCGGGGTCTTGACTTCGCCTGC<br>GATATCTACATTTGGGCCCCTCTGGCTGGTACTTGCGGGGTCCTGCTGCTT<br>TCACTCGTGATCACTCTTTACTGTAAGCGCGGTCGGAAGAAGCTGCTGTAC<br>ATCTTTAAGCAACCCTTCATGAGGCCTGTGCAGACTACTCAAGAGGAGGAC<br>GGCTGTTCATGCCGGTTCCCAGAGGAGGAGGAAGGCGGCTGCGAACTGCGC<br>GTGAAATTCAGCCGCAGCGCAGATGCTCCAGCCTACAAGCAGGGGCAGAAC<br>CAGCTCTACAACGAACTCAATCTTGGTCGGAGAGAGGAGTACGACGTGCTG<br>GACAAGCGGAGAGGACGGGACCCAGAAATGGGCGGGAAGCCGCGCAGAAAG<br>AATCCCCAAGAGGGCCTGTACAACGAGCTCCAAAAGGATAAGATGGCAGAA<br>GCCTATAGCGAGATTGGTATGAAAGGGGAACGCAGAAGAGGCAAAGGCCAC<br>GACGGACTGTACCAGGGACTCAGCACCGCCACCAAGGACACCTATGACGCT<br>CTTCACATGCAGGCCCTGCCGCCTCGG |
| 139108 | | |
| 139108-aa Full CAR | 8558 | MALPVTALLLPLALLLHAARPQVQLVESGGGLVKPGGSLRLSCAASGFTFS<br>DYYMSWIRQAPGKGLEWVSYISSSGSTIYYADSVKGRFTISRDNAKNSLYL<br>QMNSLRAEDTAVYYCARESGDGMDVWGQGTTVTVSSASGGGSGGGGRASGG<br>GSDIQMTQSPSSLSASVGDRVTITCRASQSISSYLNWYQQKPGKAPKLLIY<br>AASSLQSGVPSRFSGSGSGTDFTLTISSLQPEDFATYYCQQSYTLAFGQGT<br>KVDIKTTTPAPRPPTPAPTIASQPLSLRPEACRPAAGGAVHTRGLDFACDI<br>YIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDK<br>RRGRDPEMGGKPRRKNPQEGLYNELQKDKMAEAYSEIGMKGERRRGKGHDG<br>LYQGLSTATKDTYDALHMQALPPR |
| 139108-nt Full CAR | 8573 | ATGGCCCTCCCTGTCACCGCCCTGCTGCTTCCGCTGGCTCTTCTGCTCCAC<br>GCCGCTCGGCCCCAAGTGCAACTCGTGGAATCTGGTGGAGGACTCGTGAAA<br>CCTGGAGGATCATTGAGACTGTCATGCGCGGCCTCGGGATTCACGTTCTCC<br>GATTACTACATGAGCTGGATTCGCCAGGCTCCGGGGAAGGGACTGGAATGG<br>GTGTCCTACATTTCCTCATCCGGCTCCACCATCTACTACGCGGACTCCGTG<br>AAGGGGAGATTCACCATTAGCCGCGATAACGCCAAGAACAGCCTGTACCTT<br>CAGATGAACTCCCTGCGGGCTGAAGATACTGCCGTCTACTACTGCGCAAGG<br>GAGAGCGGAGATGGGATGGACGTCTGGGGACAGGGTACCACTGTGACCGTG<br>TCGTCGGCCTCCGGCGGAGGGGGTTCGGGTGGAAGGGCCAGCGGCGGCGGA<br>GGCAGCGACATCCAGATGACCCAGTCCCCCCTCATCGCTGTCCGCCTCCGTG<br>GGCGACCGCGTCACCATCACATGCCGGGCCTCACAGTCGATCTCCTCCTAC<br>CTCAATTGGTATCAGCAGAAGCCCGGAAAGGCCCCTAAGCTTCTGATCTAC<br>GCAGCGTCCTCCCTGCAATCCGGGGTCCCATCTCGGTTCTCCGGCTCGGGC<br>AGCGGTACCGACTTCACTCTGACCATCTCGAGCCTGCAGCCGGAGGACTTC<br>GCCACTTACTACTGTCAGCAAAGCTACACCCTCGCGTTTGGCCAGGGCACC<br>AAAGTGGACATCAAGACCACTACCCCAGCACCGAGGCCACCCACCCCGGCT<br>CCTACCATCGCCTCCCAGCCTCTGTCCCTGCGTCCGGAGGCATGTAGACCC<br>GCAGCTGGTGGGGCCGTGCATACCCGGGGTCTTGACTTCGCCTGCGATATC<br>TACATTTGGGCCCCTCTGGCTGGTACTTGCGGGGTCCTGCTGCTTTCACTC<br>GTGATCACTCTTTACTGTAAGCGCGGTCGGAAGAAGCTGCTGTACATCTTT<br>AAGCAACCCTTCATGAGGCCTGTGCAGACTACTCAAGAGGAGGACGGCTGT<br>TCATGCCGGTTCCCAGAGGAGGAGGAAGGCGGCTGCGAACTGCGCGTGAAA<br>TTCAGCCGCAGCGCAGATGCTCCAGCCTACAAGCAGGGGCAGAACCAGCTC<br>TACAACGAACTCAATCTTGGTCGGAGAGAGGAGTACGACGTGCTGGACAAG<br>CGGAGAGGACGGGACCCAGAAATGGGCGGGAAGCCGCGCAGAAAGAATCCC<br>CAAGAGGGCCTGTACAACGAGCTCCAAAAGGATAAGATGGCAGAAGCCTAT<br>AGCGAGATTGGTATGAAAGGGGAACGCAGAAGAGGCAAAGGCCACGACGGA<br>CTGTACCAGGGACTCAGCACCGCCACCAAGGACACCTATGACGCTCTTCAC<br>ATGCAGGCCCTGCCGCCTCGG |
| 139110 | | |
| 139110-aa Full CAR | 8560 | MALPVTALLLPLALLLHAARPQVQLVQSGGGLVKPGGSLRLSCAASGFTFS<br>DYYMSWIRQAPGKGLEWVSYISSSGNTIYYADSVKGRFTISRDNAKNSLYL<br>QMNSLRAEDTAVYYCARSTMVREDYWGQGTLVTVSSASGGGGSGGRASGGG |

TABLE 23-continued

Exemplary BCMA CAR molecules. Sequences are provided with a leader sequence.

| Name/<br>Description | SEQ ID<br>NO: | Sequence |
|---|---|---|
| | | GSDIVLTQSPLSLPVTLGQPASISCKSSESLVHNSGKTYLNWFHQRPGQSP<br>RRLIYEVSNRDSGVPDRFTGSGSGTDFTLKISRVEAEDVGVYYCMQGTHWP<br>GTFGQGTKLEIKTTTPAPRPPTPAPTIASQPLSLRPEACRPAAGGAVHTRG<br>LDFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRRE<br>EYDVLDKRRGRDPEMGGKPRRKNPQEGLYNELQKDKMAEAYSEIGMKGERR<br>RGKGHDGLYQGLSTATKDTYDALHMQALPPR |
| 139110-nt<br>Full CAR | 8575 | ATGGCCCTCCCTGTCACCGCCCTGCTGCTTCCGCTGGCTCTTCTGCTCCAC<br>GCCGCTCGGCCCCAAGTGCAACTGGTGCAAAGCGGAGGAGGATTGGTCAAA<br>CCCGGAGGAAGCCTGAGACTGTCATGCGCGGCCTCTGGATTCACCTTCTCC<br>GATTACTACATGTCATGGATCAGACAGGCCCCGGGGAAGGGCCTCGAATGG<br>GTGTCCTACATCTCGTCCTCCGGGAACACCATCTACTACGCCGACAGCGTG<br>AAGGGCCGCTTTACCATTTCCCGCGACAACGCAAAGAACTCGCTGTACCTT<br>CAGATGAATTCCTGCGGGCTGAAGATACCGCGGTGTACTATTGCGCCCGG<br>TCCACTATGGTCCGGGAGGACTACTGGGGACAGGGCACACTCGTGACCGTG<br>TCCAGCGCGAGCGGGGGTGGAGGCAGCGGTGGACGCGCCTCCGGCGGCGGC<br>GGTTCAGACATCGTGCTGACTCAGTCGCCCCTGTCGCTGCCGGTCACCCTG<br>GGCCAACCGGCCTCAATTAGCTGCAAGTCCTCGGAGAGCCTGGTGCACAAC<br>TCAGGAAAGACTTACCTGAACTGGTTCCATCAGCGGCCTGGACAGTCCCCA<br>CGGAGGCTCATCTATGAAGTGTCCAACAGGGATTCGGGGGTGCCCGACCGC<br>TTCACTGGCTCCGGGTCCGGCACCGACTTCACCTTGAAAATCTCCAGAGTG<br>GAAGCCGAGGACGTGGGCGTGTACTACTGTATGCAGGGTACCCACTGGCCT<br>GGAACCTTTGGACAAGGAACTAAGCTCGAGATTAAGACCACTACCCCAGCA<br>CCGAGGCCACCCACCCCGGCTCCTACCATCGCCTCCCAGCCTCTGTCCCTG<br>CGTCCGGAGGCATGTAGACCCGCAGCTGGTGGGGCCGTGCATACCCGGGGT<br>CTTGACTTCGCCTGCGATATCTACATTTGGGCCCCTCTGGCTGGTACTTGC<br>GGGGTCCTGCTGCTTTCACTCGTGATCACTCTTTACTGTAAGCGCGGTCGG<br>AAGAAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAAGGC<br>GGCTGCGAACTGCGCGTGAAATTCAGCCGCAGCGCAGATGCTCCAGCCTAC<br>AAGCAGGGGCAGAACCAGCTCTACAACGAACTCAATCTTGGTCGGAGAGAG<br>GAGTACGACGTGCTGGACAAGCGGAGAGGACGGGACCCAGAAATGGGCGGG<br>AAGCCGCGCAGAAAGAATCCCCAAGAGGGCCTGTACAACGAGCTCCAAAAG<br>GATAAGATGGCAGAAGCCTATAGCGAGATTGGTATGAAAGGGGAACGCAGA<br>AGAGGCAAAGGCCACGACGGACTGTACCAGGGACTCAGCACCGCCACCAAG<br>GACACCTATGACGCTCTTCACATGCAGGCCCTGCCGCCTCGG |
| 139112 | | |
| 139112-aa<br>Full CAR | 8561 | MALPVTALLLPLALLLHAARPQVQLVESGGGLVQPGGSLRLSCAVSGFALS<br>NHGMSWVRRAPGKGLEWVSGIVYSGSTYYAASVKGRFTISRDNSRNTLYLQ<br>MNSLRPEDTAIYYCSAHGGESDVWGQGTTVTVSSASGGGGSGGRASGGGGS<br>DIRLTQSPSPLSASVGDRVTITCQASEDINKFLNWYHQTPGKAPKLLIYDA<br>STLQTGVPSRFSGSGSGTDFTLTINSLQPEDIGTYYCQQYESLPLTFGGGT<br>KVEIKTTTPAPRPPTPAPTIASQPLSLRPEACRPAAGGAVHTRGLDFACDI<br>YIWAPLAGTCGVLLLSLVITLYCKRGRKKLLYIFKQPFMRPVQTTQEEDGC<br>SCRFPEEEEGGCELRVKFSRSADAPAYKQGQNQLYNELNLGRREEYDVLDK<br>RRGRDPEMGGKPRRKNPQEGLYNELQKDKMAEAYSEIGMKGERRRGKHDG<br>LYQGLSTATKDTYDALHMQALPPR |
| 139112-nt<br>Full CAR | 8576 | ATGGCCCTCCCTGTCACCGCCCTGCTGCTTCCGCTGGCTCTTCTGCTCCAC<br>GCCGCTCGGCCCCAAGTGCAACTCGTGGAATCTGGTGGAGGACTCGTGCAA<br>CCCGGTGGAAGCCTTAGGCTGTCGTGCGCCGTCAGCGGGTTTGCTCTGAGC<br>AACCATGGAATGTCCTGGGTCCGCCGGGCACCGGGAAAAGGGCTGGAATGG<br>GTGTCCGGCATCGTGTACAGCGGGTCAACCTATTACGCGCGTCCGTGAAG<br>GGCAGATTCACTATCTCAAGAGACAACAGCCGGAACACCCTGTACTTGCAA<br>ATGAATTCCCTGCGCCCCGAGGACACCGCCATCTACTACTGCTCCGCCCAC<br>GGAGGAGAGTCGGACGTGTGGGGCCAGGGAACGACTGTGACTGTGTCCAGC<br>GCATCAGGAGGGGTGGTTCGGGCGGCCGGGCCTCGGGGGGAGGAGGTTCC<br>GACATTCGGCTGACCCAGTCCCCGTCCCCACTGTCGGCCTCCGTCGGCGAC<br>CGCGTGACCATCACTTGTCAGGCGTCCGAGGACATTAACAAGTTCCTGAAC<br>TGGTACCACCAGACCCCTGGAAAGGCCCCCAAGCTGCTGATCTACGATGCC<br>TCGACCCTTCAAACTGGAGTGCCTAGCCGGTTCTCCGGGTCCGGCTCCGGC<br>ACTGATTTCACTCTGACCATCAACTCATTGCAGCCGGAAGATATCGGGACC<br>TACTATTGCCAGCAGTACGAATCCCTCCCGCTCACATTCGGCGGGGGAACC<br>AAGGTCGAGATTAAGACCACTACCCCAGCACCGAGGCCACCCACCCCGGCT<br>CCTACCATCGCCTCCCAGCCTCTGTCCCTGCGTCCGGAGGCATGTAGACCC<br>GCAGCTGGTGGGGCCGTGCATACCCGGGGTCTTGACTTCGCCTGCGATATC<br>TACATTTGGGCCCCTCTGGCTGGTACTTGCGGGGTCCTGCTGCTTTCACTC<br>GTGATCACTCTTTACTGTAAGCGCGGTCGGAAGAAGCTGCTGTACATCTTT<br>AAGCAACCCTTCATGAGGCCTGTGCAGACTACTCAAGAGGAGGACGGCTGT<br>TCATGCCGGTTCCCAGAGGAGGAGGAAGGCGGCTGCGAACTGCGCGTGAAA<br>TTCAGCCGCAGCGCAGATGCTCCAGCCTACAAGCAGGGGCAGAACCAGCTC<br>TACAACGAACTCAATCTTGGTCGGAGAGAGGAGTACGACGTGCTGGACAAG<br>CGGAGAGGACGGGACCCAGAAATGGGCGGGAAGCCGCGCAGAAAGAATCCC<br>CAAGAGGGCCTGTACAACGAGCTCCAAAAGGATAAGATGGCAGAAGCCTAT<br>AGCGAGATTGGTATGAAAGGGGAACGCAGAAGAGGCAAAGGCCACGACGGA |

TABLE 23-continued

Exemplary BCMA CAR molecules. Sequences are provided with a leader sequence.

| Name/<br>Description | SEQ ID<br>NO: | Sequence |
|---|---|---|
| | | CTGTACCAGGGACTCAGCACCGCCACCAAGGACACCTATGACGCTCTTCAC<br>ATGCAGGCCCTGCCGCCTCGG |
| 139113 | | |
| 139113-aa<br>Full CAR | 8562 | MALPVTALLLPLALLLHAARPEVQLVETGGGLVQPGGSLRLSCAVSGFALS<br>NHGMSWVRRAPGKGLEWVSGIVYSGSTYYAASVKGRFTISRDNSRNTLYLQ<br>MNSLRPEDTAIYYCSAHGGESDVWGQGTTVTVSSASGGGGSGGRASGGGGS<br>ETTLTQSPATLSVSPGERATLSCRASQSVGSNLAWYQQKPGQGPRLLIYGA<br>STRATGIPARFSGSGSGTEFTLTISSLQPEDFAVYYCQQYNDWLPVTFGQG<br>TKVEIKTTTPAPRPPTPAPTIASQPLSLRPEACRPAAGGAVHTRGLDFACD<br>IYIWAPLAGTCGVLLLSLVITLYCKRGRKKLLYIFKQPFMRPVQTTQEEDG<br>CSCRFPEEEEGGCELRVKFSRSADAPAYKQGQNQLYNELNLGRREEYDVLD<br>KRRGRDPEMGGKPRRKNPQEGLYNELQKDKMAEAYSEIGMKGERRRGKGHD<br>GLYQGLSTATKDTYDALHMQALPPR |
| 139113-nt<br>Full CAR | 8577 | ATGGCCCTCCCTGTCACCGCCCTGCTGCTTCCGCTGGCTCTTCTGCTCCAC<br>GCCGCTCGGCCCGAAGTGCAATTGGTGGAAACTGGAGGAGGACTTGTGCAA<br>CCTGGAGGATCATTGCGGCTCTCATGCGCTGTCTCCGGCTTCGCCCTGTCA<br>AATCACGGGATGTCGTGGGTCAGACGGGCCCCGGGAAAGGGTCTGGAATGG<br>GTGTCGGGGATTGTGTACAGCGGCTCCACCTACTACGCCGCTTCGGTCAAG<br>GGCCGCTTCACTATTTCACGGGACAACAGCCGCAACACCCTCTATCTGCAA<br>ATGAACTCTCTCCGCCCGGAGGATACCGCCATCTACTACTGCTCCGCACAC<br>GGCGGCGAATCCGACGTGTGGGGACAGGGAACCACTGTCACCGTGTCGTCC<br>GCATCCGGTGGCGGAGGATCGGGTGGCCGGGCCTCCGGGGGCGGCGGCAGC<br>GAGACTACCCTGACCCAGTCCCCTGCCACTCTGTCCGTGAGCCCGGGAGAG<br>AGAGCCACCCTTAGCTGCCGGGCCAGCCAGAGCGTGGGCTCCAACCTGGCC<br>TGGTACCAGCAGAAGCCAGGACAGGGTCCCAGGCTGCTGATCTACGGAGCC<br>TCCACTCGCGCGACCGGCATCCCCGCGAGGTTCTCCGGGTCGGGTTCCGGG<br>ACCGAGTTCACCCTGACCATCTCCTCCCTCCAACCGGAGGACTTCGCGGTG<br>TACTACTGTCAGCAGTACAACGATTGGCTGCCCGTGACATTTGGACAGGGG<br>ACGAAGGTGGAAATCAAAACCACTACCCCAGCACCGAGGCCACCCACCCCG<br>GCTCCTACCATCGCCTCCCAGCCTCTGTCCCTGCGTCCGGAGGCATGTAGA<br>CCCGCAGCTGGTGGGGCCGTGCATACCCGGGGTCTTGACTTCGCCTGCGAT<br>ATCTACATTTGGGCCCCTCTGGCTGGTACTTGCGGGGTCCTGCTGCTTTCA<br>CTCGTGATCACTCTTTACTGTAAGCGCGGTCGGAAGAAGCTGCTGTACATC<br>TTTAAGCAACCCTTCATGAGGCCTGTGCAGACTACTCAAGAGGAGGACGGC<br>TGTTCATGCCGGTTCCCAGAGGAGGAGGAAGGCGGCTGCGAACTGCGCGTG<br>AAATTCAGCCGCAGCGCAGATGCTCCAGCCTACAAGCAGGGGCAGAACCAG<br>CTCTACAACGAACTCAATCTTGGTCGGAGAGAGGAGTACGACGTGCTGGAC<br>AAGCGGAGAGGACGGGACCCAGAAATGGGCGGGAAGCCGCGCAGAAAGAAT<br>CCCCAAGAGGGCCTGTACAACGAGCTCCAAAAGGATAAGATGGCAGAAGCC<br>TATAGCGAGATTGGTATGAAAGGGGAACGCAGAAGAGGCAAAGGCCACGAC<br>GGACTGTACCAGGGACTCAGCACCGCCACCAAGGACACCTATGACGCTCTT<br>CACATGCAGGCCCTGCCGCCTCGG |
| 139114 | | |
| 139114-aa<br>Full CAR | 8563 | MALPVTALLLPLALLLHAARPEVQLVESGGGLVQPGGSLRLSCAVSGFALS<br>NHGMSWVRRAPGKGLEWVSGIVYSGSTYYAASVKGRFTISRDNSRNTLYLQ<br>MNSLRPEDTAIYYCSAHGGESDVWGQGTTVTVSSASGGGGSGGRASGGGGS<br>EIVLTQSPGTLSLSPGERATLSCRASQSIGSSSLAWYQQKPGQAPRLLMYG<br>ASSRASGIPDRFSGSGSGTDFTLTISRLEPEDFAVYYCQQYAGSPPFTFGQ<br>GTKVEIKTTTPAPRPPTPAPTIASQPLSLRPEACRPAAGGAVHTRGLDFAC<br>DIYIWAPLAGTCGVLLLSLVITLYCKRGRKKLLYIFKQPFMRPVQTTQEED<br>GCSCRFPEEEEGGCELRVKFSRSADAPAYKQGQNQLYNELNLGRREEYDVL<br>DKRRGRDPEMGGKPRRKNPQEGLYNELQKDKMAEAYSEIGMKGERRRGKGH<br>DGLYQGLSTATKDTYDALHMQALPPR |
| 139114-nt<br>Full CAR | 8578 | ATGGCCCTCCCTGTCACCGCCCTGCTGCTTCCGCTGGCTCTTCTGCTCCAC<br>GCCGCTCGGCCCGAAGTGCAATTGGTGGAATCTGGTGGAGGACTTGTGCAA<br>CCTGGAGGATCACTGAGACTGTCATGCGCGGTGTCCGGTTTTGCCCTGAGC<br>AATCATGGGATGTCGTGGGTCCGGCGCGCCCCCGGAAAGGGTCTGGAATGG<br>GTGTCGGGTATCGTCTACTCCGGGAGCACTTACTACGCCGCGAGCGTGAAG<br>GGCCGCTTCACCATTTCCCGCGATAACTCCCGCAACACCCTGTACTTGCAA<br>ATGAACTCGCTCCGGCCTGAGGACACTGCCATCTACTACTGCTCCGCACAC<br>GGAGGAGAATCCGACGTGTGGGGCCAGGGAACTACCGTGACCGTCAGCAGC<br>GCCTCCGGCGGCGGGGGCTCAGGCGGACGGGCTAGCGGCGGCGGTGGCTCC<br>GAGATCGTGCTGACCCAGTCGCCTGGCACTCTCTCGCTGAGCCCCGGGGAA<br>AGGGCAACCCTGTCCTGTCGGGCCAGCCAGTCCATTGGATCATCCTCCCTC<br>GCCTGGTATCAGCAGAAACCGGGACAGGCTCCGCGGCTGCTTATGTATGGG<br>GCCAGCTCAAGAGCCTCCGGCATTCCCGACCGGTTCTCCGGGTCCGGTTCC<br>GGCACCGATTTCACCCTGACTATCTCGAGGCTGGAGCCAGAGGACTTCGCC<br>GTGTACTACTGCCAGCAGTACGCGGGTCCCGCCGTTCACGTTCGGACAG<br>GGAACCAAGGTCGAGATCAAGACCACTACCCCAGCACCGAGGCCACCCACC<br>CCGGCTCCTACCATCGCCTCCCAGCCTCTGTCCCTGCGTCCGGAGGCATGT<br>AGACCCGCAGCTGGTGGGGCCGTGCATACCCGGGGTCTTGACTTCGCCTGC |

TABLE 23-continued

Exemplary BCMA CAR molecules. Sequences are provided with a leader sequence.

| Name/ Description | SEQ ID NO: | Sequence |
| --- | --- | --- |
| | | GATATCTACATTTGGGCCCCTCTGGCTGGTACTTGCGGGGTCCTGCTGCTT TCACTCGTGATCACTCTTTACTGTAAGCGCGGTCGGAAGAAGCTGCTGTAC ATCTTTAAGCAACCCTTCATGAGGCCTGTGCAGACTACTCAAGAGGAGGAC GGCTGTTCATGCCGGTTCCCAGAGGAGGAGGAAGGCGGCTGCGAACTGCGC GTGAAATTCAGCCGCAGCGCAGATGCTCCAGCCTACAAGCAGGGGCAGAAC CAGCTCTACAACGAACTCAATCTTGGTCGGAGAGAGGAGTACGACGTGCTG GACAAGCGGAGAGGACGGGACCCAGAAATGGGCGGGAAGCCGCGCAGAAAG AATCCCCAAGAGGGCCTGTACAACGAGCTCCAAAAGGATAAGATGGCAGAA GCCTATAGCGAGATTGGTATGAAAGGGGAACGCAGAAGAGGCAAAGGCCAC GACGGACTGTACCAGGGACTCAGCACCGCCACCAAGGACACCTATGACGCT CTTCACATGCAGGCCCTGCCGCCTCGG |
| 149362 | | |
| 149362-aa Full CAR | 8579 | MALPVTALLLPLALLLHAARPQVQLQESGPGLVKPSETLSLTCTVSGGSIS SSYYYWGWIRQPPGKGLEWIGSIYYSGSAYYNPSLKSRVTISVDTSKNQFS LRLSSVTAADTAVYYCARHWQEWPDAFDIWGQGTMVTVSSGGGGSGGGGSG GGGSETTLTQSPAFMSATPGDKVIISCKASQDIDDAMNWYQQKPGEAPLFI IQSATSPVPGIPPRFSGSGFGTDFSLTINNIESEDAAYYFCLQHDNFPLTF GQGTKLEIKTTTPAPRPPTPAPTIASQPLSLRPEACRPAAGGAVHTRGLDF ACDIYIWAPLAGTCGVLLLSLVITLYCKRGRKKLLYIFKQPFMRPVQTTQE EDGCSCRFPEEEEGGCELRVKFSRSADAPAYKQGQNQLYNELNLGRREEYD VLDKRRGRDPEMGGKPRRKNPQEGLYNELQKDKMAEAYSEIGMKGERRRGK GHDGLYQGLSTATKDTYDALHMQALPPR |
| 149362-nt Full CAR | 8601 | ATGGCCCTCCCTGTCACCGCCCTGCTGCTTCCGCTGGCTCTTCTGCTCCAC GCCGCTCGGCCCAAGTGCAGCTTCAGGAAAGCGGACCGGGCCTGGTCAAG CCATCCGAAACTCTCTCCCTGACTTGCACTGTGTCTGGCGGTTCCATCTCA TCGTCGTACTACTACTGGGGCTGGATTAGGCAGCCGCCCGGAAAGGGACTG GAGTGGATCGGAAGCATCTACTATTCCGGCTCGGCGTACTACAACCCTAGC CTCAAGTCGAGAGTGACCATCTCCGTGGATACCTCCAAGAACCAGTTTTCC CTGCGCCTGAGCTCCGTGACCGCCGCTGACACCGCCGTGTACTACTGTGCT CGGCATTGGCAGGAATGGCCCGATGCCTTCGACATTTGGGGCCAGGGCACT ATGGTCACTGTGTCATCCGGGGGTGGAGGCAGCGGGGGAGGAGGGTCCGGG GGGGGAGGTTCAGAGACAACCTTGACCCAGTCACCCGCATTCATGTCCGCC ACTCCGGGAGACAAGGTCATCATCTCGTGCAAAGCGTCCCAGGATATCGAC GATGCCATGAATTGGTACCAGCAGAAGCCTGGCGAAGCGCCGCTGTTCATT ATCCAATCCGCAACCTCGCCCGTGCCTGGAATCCCACCGCGGTTCAGCGGC AGCGGTTTCGGAACCGACTTTTCCCTGACCATTAACAACATTGAGTCCGAG GACGCCGCCTACTACTTCTGCCTGCAACACGACAACTTCCCTCTCACGTTC GGCCAGGGAACCAAGCTGGAAATCAAGACCACTACCCCAGCACCGAGGCCA CCCACCCCGGCTCCTACCATCGCCTCCCAGCCTCTGTCCCTGCGTCCGGAG GCATGTAGACCCGCAGCTGGTGGGGCCGTGCATACCCGGGGTCTTGACTTC GCCTGCGATATCTACATTTGGGCCCCTCTGGCTGGTACTTGCGGGGTCCTG CTGCTTTCACTCGTGATCACTCTTTACTGTAAGCGCGGTCGGAAGAAGCTG CTGTACATCTTTAAGCAACCCTTCATGAGGCCTGTGCAGACTACTCAAGAG GAGGACGGCTGTTCATGCCGGTTCCCAGAGGAGGAGGAAGGCGGCTGCGAA CTGCGCGTGAAATTCAGCCGCAGCGCAGATGCTCCAGCCTACAAGCAGGGG CAGAACCAGCTCTACAACGAACTCAATCTTGGTCGGAGAGAGGAGTACGAC GTGCTGGACAAGCGGAGAGGACGGGACCCAGAAATGGGCGGGAAGCCGCGC AGAAAGAATCCCCAAGAGGGCCTGTACAACGAGCTCCAAAAGGATAAGATG GCAGAAGCCTATAGCGAGATTGGTATGAAAGGGGAACGCAGAAGAGGCAAA GGCCACGACGGACTGTACCAGGGACTCAGCACCGCCACCAAGGACACCTAT GACGCTCTTCACATGCAGGCCCTGCCGCCTCGG |
| 149363 | | |
| 149363-aa Full CAR | 8580 | MALPVTALLLPLALLLHAARPQVNLRESGPALVKPTQTLTLTCTFSGFSLR TSGMCVSWIRQPPGKALEWLARIDWDEDKFYSTSLKTRLTISKDTSDNQVV LRMTNMDPADTATYYCARSGAGGTSATAFDIWGPGTMVTVSSGGGGSGGGG SGGGGSDIQMTQSPSSLSASVGDRVTITCRASQDIYNNLAWFQLKPGSAPR SLMYAANKSQSGVPSRFSGSASGTDFTLTISSLQPEDFATYYCQHYYRFPY SFGQGTKLEIKTTTPAPRPPTPAPTIASQPLSLRPEACRPAAGGAVHTRGL DFACDIYIWAPLAGTCGVLLLSLVITLYCKRGRKKLLYIFKQPFMRPVQTT QEEDGCSCRFPEEEEGGCELRVKFSRSADAPAYKQGQNQLYNELNLGRREE YDVLDKRRGRDPEMGGKPRRKNPQEGLYNELQKDKMAEAYSEIGMKGERRR GKGHDGLYQGLSTATKDTYDALHMQALPPR |
| 149363-nt Full CAR | 8602 | ATGGCCCTCCCTGTCACCGCCCTGCTGCTTCCGCTGGCTCTTCTGCTCCAC GCCGCTCGGCCCAAGTCAATCTGCGCGAATCCGGCCCGCCTTGGTCAAG CCTACCCAGACCCTCACTCTGACCTGTACTTTCTCCGGCTTCTCCCTGCGG ACTTCCGGGATGTGCGTGTCCTGGATCAGACAGCCTCCGGGAAAGGCCCTG GAGTGGCTCGCTCGCATTGACTGGGATGAGGACAAGTTCTACTCCACCTCA CTCAAGACCAGGCTGACCATCAGCAAGATACCTCTGACAACCAAGTGGTG CTCCGCATGACCAACATGGACCCAGCCGACACTGCCACTTACTACTGCGCG AGGAGCGGAGCGGGCGGAACCTCCGCCACCGCCTTCGATATTTGGGGCCCG GGTACCATGGTCACCGTGTCAAGCGGAGGAGGGGGGTCCGGGGGCGGCGGT |

TABLE 23-continued

Exemplary BCMA CAR molecules. Sequences are provided with a leader sequence.

| Name/ Description | SEQ ID NO: | Sequence |
|---|---|---|
| | | TCCGGGGGAGGCGGATCGGACATTCAGATGACTCAGTCACCATCGTCCCTG<br>AGCGCTAGCGTGGGCGACAGAGTGACAATCACTTGCCGGGCATCCCAGGAC<br>ATCTATAACAACCTTGCGGTTCCAGCTGAAGCCTGGTTCCGCACCGCGG<br>TCACTTATGTACGCCGCCAACAAGAGCCAGTCGGGAGTGCCGTCCCGGTTT<br>TCCGGTTCGGCCTCGGGAACTGACTTCACCCTGACGATCTCCAGCCTGCAA<br>CCCGAGGATTTCGCCACCTACTACTGCCAGCACTACTACCGCTTTCCCTAC<br>TCGTTCGGACAGGGAACCAAGCTGGAAATCAAGACCACTACCCCAGCACCG<br>AGGCCACCCACCCCGGCTCCTACCATCGCCTCCCAGCCTCTGTCCCTGCGT<br>CCGGAGGCATGTAGACCCGCAGCTGGTGGGGCCGTGCATACCCGGGGTCTT<br>GACTTCGCCTGCGATATCTACATTTGGGCCCCTCTGGCTGGTACTTGCGGG<br>GTCCTGCTGCTTTCACTCGTGATCACTCTTTACTGTAAGCGCGGTCGGAAG<br>AAGCTGCTGTACATCTTTAAGCAACCCTTCATGAGGCCTGTGCAGACTACT<br>CAAGAGGAGGACGGCTGTTCATGCCGGTTCCCAGAGGAGGAGGAAGGCGGC<br>TGCGAACTGCGCGTGAAATTCAGCCGCAGCGCAGATGCTCCAGCCTACAAG<br>CAGGGGCAGAACCAGCTCTACAACGAACTCAATCTTGGTCGGAGAGAGGAG<br>TACGACGTGCTGGACAAGCGGAGAGGACGGGACCCAGAAATGGGCGGGAAG<br>CCGCGCAGAAAGAATCCCCAAGAGGGCCTGTACAACGAGCTCCAAAAGGAT<br>AAGATGGCAGAAGCCTATAGCGAGATTGGTATGAAAGGGGAACGCAGAAGA<br>GGCAAAGGCCACGACGGACTGTACCAGGGACTCAGCACCGCCACCAAGGAC<br>ACCTATGACGCTCTTCACATGCAGGCCCTGCCGCCTCGG |
| 149364 | | |
| 149364-aa Full CAR | 8581 | MALPVTALLLPLALLLHAARPEVQLVESGGGLVKPGGSLRLSCAASGFTFS<br>SYSMNWVRQAPGKGLEWVSSISSSSSYIYYADSVKGRFTISRDNAKNSLYL<br>QMNSLRAEDTAVYYCAKTIAAVYAFDIWGQGTTVTVSSGGGGSGGGGSGGG<br>GSEIVLTQSPLSLPVTPEEPASISCRSSQSLLHSNGYNYLDWYLQKPGQSP<br>QLLIYLGSNRASGVPDRFSGSGSGTDFTLKISRVEAEDVGVYYCMQALQTP<br>YTFGQGTKLEIKTTTPAPRPPTPAPTIASQPLSLRPEACRPAAGGAVHTRG<br>LDFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRRE<br>EYDVLDKRRGRDPEMGGKPRRKNPQEGLYNELQKDKMAEAYSEIGMKGERR<br>RGKGHDGLYQGLSTATKDTYDALHMQALPPR |
| 149364-nt Full CAR | 8603 | ATGGCCCTCCCTGTCACCGCCCTGCTGCTTCCGCTGGCTCTTCTGCTCCAC<br>GCCGCTCGGCCCGAAGTGCAGCTTGTCGAATCCGGGGGGGACTGGTCAAG<br>CCGGGCGGATCACTGAGACTGTCCTGCGCCGCGAGCGGCTTCACGTTCTCC<br>TCCTACTCCATGAACTGGGTCCGCCAAGCCCCCGGGAAGGGACTGGAATGG<br>GTGTCCTCTATCTCCTCGTCGTCGTCCTACATCTACTACGCCGACTCCGTG<br>AAGGGAAGATTCACCATTTCCCGCGACAACGCAAAGAACTCACTGTACTTG<br>CAAATGAACTCACTCCGGGCCGAAGATACTGCTGTGTACTATTGCGCCAAG<br>ACTATTGCCGCCGTCTACGCTTTCGACATCTGGGGCCAGGGAACCACCGTG<br>ACTGTGTCGTCCGGTGGTGGTGGCTCGGCGGAGGAGGAAGCGGCGGCGGG<br>GGGTCCGAGATTGTGCTGACCCAGTCGCCACTGAGCCTCCCTGTGACCCCC<br>GAGGAACCCGCCAGCATCAGCTGCCGGTCCAGCCAGTCCCTGCTCCACTCC<br>AACGGATACAATTACCTCGATTGGTACCTTCAGAAGCCTGGACAAAGCCCG<br>CAGCTGCTCATCTACTTGGGATCAAACCGCGCGTCAGGAGTGCCTGACCGG<br>TTCTCCGGCTCGGGCAGCGGTACCGATTTCACCCTGAAAATCTCCAGGGTG<br>GAGGCAGAGGACGTGGGAGTGTATTACTGTATGCAGGCGCTGCAGACTCCG<br>TACACATTTGGGCAGGGCACCAAGCTGGAGATCAAGACCACTACCCCAGCA<br>CCGAGGCCACCCACCCCGGCTCCTACCATCGCCTCCCAGCCTCTGTCCCTG<br>CGTCCGGAGGCATGTAGACCCGCAGCTGGTGGGGCCGTGCATACCCGGGGT<br>CTTGACTTCGCCTGCGATATCTACATTTGGGCCCCTCTGGCTGGTACTTGC<br>GGGGTCCTGCTGCTTTCACTCGTGATCACTCTTTACTGTAAGCGCGGTCGG<br>AAGAAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAAGGC<br>GGCTGCGAACTGCGCGTGAAATTCAGCCGCAGCGCAGATGCTCCAGCCTAC<br>AAGCAGGGGCAGAACCAGCTCTACAACGAACTCAATCTTGGTCGGAGAGAG<br>GAGTACGACGTGCTGGACAAGCGGAGAGGACGGGACCCAGAAATGGGCGGG<br>AAGCCGCGCAGAAAGAATCCCCAAGAGGGCCTGTACAACGAGCTCCAAAAG<br>GATAAGATGGCAGAAGCCTATAGCGAGATTGGTATGAAAGGGGAACGCAGA<br>AGAGGCAAAGGCCACGACGGACTGTACCAGGGACTCAGCACCGCCACCAAG<br>GACACCTATGACGCTCTTCACATGCAGGCCCTGCCGCCTCGG |
| 149365 | | |
| 149365-aa Full CAR | 8582 | MALPVTALLLPLALLLHAARPEVQLVESGGGLVKPGGSLRLSCAASGFTFS<br>DYYMSWIRQAPGKGLEWVSYISSSGSTIYYADSVKGRFTISRDNAKNSLYL<br>QMNSLRAEDTAVYYCARDLRGAFDIWGQGTMVTVSSGGGGSGGGGSGGGGS<br>SYVLTQSPSVSAAPGYTATISCGGNNIGTKSVHWYQQKPGQAPLLVIRDDS<br>VRPSKIPGRFSGSNSGNMATLTISGVQAGDEADFYCQVWDSDSEHVVEGGG<br>TKLTVLTTTPAPRPPTPAPTIASQPLSLRPEACRPAAGGAVHTRGLDFACD<br>IYIWAPLAGTCGVLLLSLVITLYCKRGRKKLLYIFKQPFMRPVQTTQEEDG<br>CSCRFPEEEEGGCELRVKFSRSADAPAYKQGQNQLYNELNLGRREEYDVLD<br>KRRGRDPEMGGKPRRKNPQEGLYNELQKDKMAEAYSEIGMKGERRRGKGHD<br>GLYQGLSTATKDTYDALHMQALPPR |

TABLE 23-continued

Exemplary BCMA CAR molecules. Sequences are provided with a leader sequence.

| Name/ Description | SEQ ID NO: | Sequence |
|---|---|---|
| 149365-nt Full CAR | 8604 | ATGGCCCTCCCTGTCACCGCCCTGCTGCTTCCGCTGGCTCTTCTGCTCCAC GCCGCTCGGCCCGAAGTCCAGCTCGTGGAGTCCGGCGGAGGCCTTGTGAAG CCTGGAGGTTCGCTGAGACTGTCCTGCGCCGCCTCCGGCTTCACCTTCTCC GACTACTACATGTCCTGGATCAGACAGGCCCCGGGAAAGGGCCTGGAATGG GTGTCCTACATCTCGTCATCGGGCAGCACTATCTACTACGCGGACTCAGTG AAGGGGCGGTTCACCATTTCCCGGGATAACGCGAAGAACTCGCTGTATCTG CAAATGAACTCACTGAGGGCCGAGGACACCGCCGTGTACTACTGCGCCCGC GATCTCCGCGGGGCATTTGACATCTGGGGACAGGGAACCATGGTCACAGTG TCCAGCGGAGGGGGAGGATCGGGTGGCGGAGGTTCCGGGGGTGGAGGCTCC TCCTACGTGCTGACTCAGAGCCCAAGCGTCAGCGCTGCGCCCGGTTACACG GCAACCATCTCCTGTGGCGGAAACAACATTGGGACCAAGTCTGTGCACTGG TATCAGCAGAAGCGGGCCAAGCTCCCTGTTGGTGATCCGCGATGACTCC GTGCGGCCTAGCAAAATTCCGGGACGGTTCTCCGGCTCCAACAGCGGCAAT ATGGCCACTCTCACCATCTCGGGAGTGCAGGCCGGAGATGAAGCCGACTTC TACTGCCAAGTCTGGGACTCAGACTCCGAGCATGTGGTGTTCGGGGGCGGA ACCAAGCTGACTGTGCTCACCACTACCCCAGCACCGAGGCCACCCACCCCG GCTCCTACCATCGCCTCCCAGCCTCTGTCCCTGCGTCCGGAGGCATGTAGA CCCGCAGCTGGTGGGGCCGTGCATACCCGGGGTCTTGACTTCGCCTGCGAT ATCTACATTTGGGCCCCTCTGGCTGGTACTTGCGGGGTCCTGCTGCTTTCA CTCGTGATCACTCTTTACTGTAAGCGCGGTCGGAAGAAGCTGCTGTACATC TTTAAGCAACCCTTCATGAGGCCTGTGCAGACTACTCAAGAGGAGGACGGC TGTTCATGCCGGTTCCCAGAGGAGGAGGAAGGCGGCTGCGAACTGCGCGTG AAATTCAGCCGCAGCGCAGATGCTCCAGCCTACAAGCAGGGGCAGAACCAG CTCTACAACGAACTCAATCTTGGTCGGAGAGAGGAGTACGACGTGCTGGAC AAGCGGAGAGGACGGGACCCAGAAATGGGCGGGAAGCCGCGCAGAAAGAAT CCCCAAGAGGGCCTGTACAACGAGCTCCAAAAGGATAAGATGGCAGAAGCC TATAGCGAGATTGGTATGAAAGGGGAACGCAGAAGAGGCAAAGGCCACGAC GGACTGTACCAGGGACTCAGCACCGCCACCAAGGACACCTATGACGCTCTT CACATGCAGGCCCTGCCGCCTCGG |
| 149366 | | |
| 149366-aa Full CAR | 8583 | MALPVTALLLPLALLLHAARPQVQLVQSGAEVKKPGASVKVSCKPSGYTVT SHYIHWVRRAPGQGLEWMGMINPSGGVTAYSQTLQGRVTMTSDTSSSTVYM ELSSLRSEDTAMYYCAREGSGSGWYFDFWGRGTLVTVSSGGGGSGGGGSGG GGSSYVLTQPPSVSVSPGQTASITCSGDGLSKKYVSWYQQKAGQSPVVLIS RDKERPSGIPDRFSGSNSADTATLTISGTQAMDEADYYCQAWDDTTVVEGG GTKLTVLTTTPAPRPPTPAPTIASQPLSLRPEACRPAAGGAVHTRGLDFAC DIYIWAPLAGTCGVLLLSLVITLYCKRGRKKLLYIFKQPFMRPVQTTQEED GCSCRFPEEEEGGCELRVKFSRSADAPAYKQGQNQLYNELNLGRREEYDVL DKRRGRDPEMGGKPRRKNPQEGLYNELQKDKMAEAYSEIGMKGERRRGKGH DGLYQGLSTATKDTYDALHMQALPPR |
| 149366-nt Full CAR | 8605 | ATGGCCCTCCCTGTCACCGCCCTGCTGCTTCCGCTGGCTCTTCTGCTCCAC GCCGCTCGGCCCAAGTGCAGCTGGTGCAGAGCGGGCCGAAGTCAAGAAG CCGGGGAGCCTCCGTGAAAGTGTCCTGCAAGCCTTCGGGATACACCGTGACC TCCCACTACATTCATTGGGTCCGCCGCGCCCCCGGCCAAGGACTCGAGTGG ATGGGCATGATCAACCCTAGCGGCGGAGTGACCGCGTACAGCCAGACGCTG CAGGGACGCGTGACTATGACCTCGGATACCTCCTCCTCCACCGTCTATATG GAACTGTCCAGCCTGCGGTCCGAGGATACCGCCATGTACTACTGCGCCCGG GAAGGATCAGGCTCCGGGTGGTATTTCGACTTCTGGGGAAGAGGCACCCTC GTGACTGTGTCATCTGGGGAGGGGGTTCCGGTGGTGGCGGATCGGGAGGA GGCGGTTCATCCTACGTGCTGACCCAGCCACCCTCCGTGTCCGTGAGCCCC GGCCAGACTGCATCGATTACATGTAGCGGCGACGGCCTCTCCAAGAAATAC GTGTCGTGGTACCAGCAGAAGGCCGGACAGAGCCCGGTGGTGCTGATCTCA AGAGATAAGGAGCGGCCTAGCGGAATCCCGGACAGGTTCTCGGGTTCCAAC TCCGCGGACACTGCTACTCTGACCATCTCGGGGACCCAGGCTATGGACGAA GCCGATTACTACTGCCAAGCTGGGACGACACTACTGTCGTGTTTGGAGGG GGCACCAAGTTGACCGTCCTTACCACTACCCCAGCACCGAGGCCACCCACC CCGGCTCCTACCATCGCCTCCCAGCCTCTGTCCCTGCGTCCGGAGGCATGT AGACCCGCAGCTGGTGGGGCCGTGCATACCCGGGGTCTTGACTTCGCCTGC GATATCTACATTTGGGCCCCTCTGGCTGGTACTTGCGGGGTCCTGCTGCTT TCACTCGTGATCACTCTTTACTGTAAGCGCGGTCGGAAGAAGCTGCTGTAC ATCTTTAAGCAACCCTTCATGAGGCCTGTGCAGACTACTCAAGAGGAGGAC GGCTGTTCATGCCGGTTCCCAGAGGAGGAGGAAGGCGGCTGCGAACTGCGC GTGAAATTCAGCCGCAGCGCAGATGCTCCAGCCTACAAGCAGGGGCAGAAC CAGCTCTACAACGAACTCAATCTTGGTCGGAGAGAGGAGTACGACGTGCTG GACAAGCGGAGAGGACGGGACCCAGAAATGGGCGGGAAGCCGCGCAGAAAG AATCCCCAAGAGGGCCTGTACAACGAGCTCCAAAAGGATAAGATGGCAGAA GCCTATAGCGAGATTGGTATGAAAGGGGAACGCAGAAGAGGCAAAGGCCAC GACGGACTGTACCAGGGACTCAGCACCGCCACCAAGGACACCTATGACGCT CTTCACATGCAGGCCCTGCCGCCTCGG |

TABLE 23-continued

Exemplary BCMA CAR molecules. Sequences are provided with a leader sequence.

| Name/ Description | SEQ ID NO: | Sequence |
|---|---|---|
| 149367 | | |
| 149367-aa Full CAR | 8584 | MALPVTALLLPLALLLHAARPQVQLQESGPGLVKPSQTLSLTCTVSGGSIS SGGYYWSWIRQHPGKGLEWIGYIYYSGSTYYNPSLKSRVTISVDTSKNQFS LKLSSVTAADTAVYYCARAGIAARLRGAFDIWGQGTMVTVSSGGGGSGGGG SGGGGSDIVMTQSPSSVSASVGDRVIITCRASQGIRNWLAWYQQKPGKAPN LLIYAASNLQSGVPSRFSGSGSGADFTLTISSLQPEDVATYYCQKYNSAPF TFGPGTKVDIKTTTPAPRPPTPAPTIASQPLSLRPEACRPAAGGAVHTRGL DFACDIYIWAPLAGTCGVLLLSLVITLYCKRGRKKLLYIFKQPFMRPVQTT QEEDGCSCRFPEEEEGGCELRVKFSRSADAPAYKQGQNQLYNELNLGRREE YDVLDKRRGRDPEMGGKPRRKNPQEGLYNELQKDKMAEAYSEIGMKGERRR GKGHDGLYQGLSTATKDTYDALHMQALPPR |
| 149367-nt Full CAR | 8606 | ATGGCCCTCCCTGTCACCGCCCTGCTGCTTCCGCTGGCTCTTCTGCTCCAC GCCGCTCGGCCCCAAGTGCAGCTTCAGGAGAGCGGCCCGGGACTCGTGAAG CCGTCCCAGACCCTGTCCCTGACTTGCACCGTGTCGGGAGGAAGCATCTCG AGCGGAGGCTACTATTGGTCGTGGATTCGGCAGCACCCTGGAAAGGGCCTG GAATGGATCGGCTACATCTACTACTCCGGCTCGACCTACTACAACCCATCG CTGAAGTCCAGAGTGACAATCTCAGTGGACACGTCCAAGAATCAGTTCAGC CTGAAGCTCTCTTCCGTGACTGCGGCCGACACCGCCGTGTACTACTGCGCA CGCGCTGGAATTGCCGCCCGGCTGAGGGGTGCCTTCGACATTTGGGGACAG GGCACCATGGTCACCGTGTCCTCCGGCGGCGGAGGTTCCGGGGGTGGAGGC TCAGGAGGAGGGGGTCCGACATCGTCATGACTCAGTCGCCCTCAAGCGTC AGCGCGTCCGTCGGGGACAGAGTGATCATCACCTGTCGGGCGTCCCAGGGA ATTCGCAACTGGCTGGCCTGGTATCAGCAGAAGCCCGGAAAGGCCCCCAAC CTGTTGATCTACGCCGCCTCAAACCTCCAATCCGGGGTGCCGAGCCGCTTC AGCGGCTCCGGTTCGGGTGCCGATTTCACTCTGACCATCTCCTCCCTGCAA CCTGAAGATGTGGCTACCTACTACTGCCAAAAGTACAACTCCGCACCTTTT ACTTTCGGACCGGGGACCAAAGTGGACATTAAGACCACTACCCCAGCACCG AGGCCACCCACCCCGGCTCCTACCATCGCCTCCCAGCCTCTGTCCCTGCGT CCGGAGGCATGTAGACCCGCAGCTGGTGGGGCCGTGCATACCCGGGGTCTT GACTTCGCCTGCGATATCTACATTTGGGCCCCTCTGGCTGGTACTTGCGGG GTCCTGCTGCTTTCACTCGTGATCACTCTTTACTGTAAGCGCGGTCGGAAG AAGCTGCTGTACATCTTTAAGCAACCCTTCATGAGGCCTGTGCAGACTACT CAAGAGGAGGACGGCTGTTCATGCCGGTTCCCAGAGGAGGAGGAAGGCGGC TGCGAACTGCGCGTGAAATTCAGCCGCAGCGCAGATGCTCCAGCCTACAAG CAGGGGCAGAACCAGCTCTACAACGAACTCAATCTTGGTCGGAGAGAGGAG TACGACGTGCTGGACAAGCGGAGAGGACGGGACCCAGAAATGGGCGGGAAG CCGCGCAGAAAGAATCCCCAAGAGGGCCTGTACAACGAGCTCCAAAAGGAT AAGATGGCAGAAGCCTATAGCGAGATTGGTATGAAAGGGGAACGCAGAAGA GGCAAAGGCCACGACGGACTGTACCAGGGACTCAGCACCGCCACCAAGGAC ACCTATGACGCTCTTCACATGCAGGCCCTGCCGCCTCGG |
| 149368 | | |
| 149368-aa Full CAR | 8585 | MALPVTALLLPLALLLHAARPQVQLVQSGAEVKKPGSSVKVSCKASGGTFS SYAISWVRQAPGQGLEWMGGIIPIFGTANYAQKFQGRVTITADESTSTAYM ELSSLRSEDTAVYYCARRGGYQLLRWDVGLLRSAFDIWGQGTMVTVSSGGG GSGGGGSGGGGSSYVLTQPPSVSVAPGQTARITCGGNNIGSKSVHWYQQKP GQAPVLVLYGKNNRPSGVPDRFSGSRSGTTASLTITGAQAEDEADYYCSSR DSSGDHLRVFGTGTKVTVLTTTPAPRPPTPAPTIASQPLSLRPEACRPAAG GAVHTRGLDFACDIYIWAPLAGTCGVLLLSLVITLYCKRGRKKLLYIFKQP FMRPVQTTQEEDGCSCRFPEEEEGGCELRVKFSRSADAPAYKQGQNQLYNE LNLGRREEYDVLDKRRGRDPEMGGKPRRKNPQEGLYNELQKDKMAEAYSEI GMKGERRRGKGHDGLYQGLSTATKDTYDALHMQALPPR |
| 149368-nt Full CAR | 8607 | ATGGCCCTCCCTGTCACCGCCCTGCTGCTTCCGCTGGCTCTTCTGCTCCAC GCCGCTCGGCCCCAAGTGCAGCTGGTCCAGTCGGGCGCCGAGGTCAAGAAG CCCGGGAGCTCTGTGAAAGTGTCCTGCAAGGCCTCCGGGGGCACCTTTAGC TCCTACGCCATCTCCTGGGTCCGCCAAGCACCGGGTCAAGGCCTGGAGTGG ATGGGGGGAATTATCCCTATCTTCGGCACTGCCAACTACGCCCAGAAGTTC CAGGGACGCGTGACCATTACCGCGGACGAATCCACCTCCACCGCTTATATG GAGCTGTCCAGCTTGCGCTCGGAAGATACCGCCGTGTACTACTGCGCCCGG AGGGGTGGATACCAGCTGCTGAGATGGGACGTGGGCCTCCTGCGGTCGGCG TTCGACATCTGGGGCCAGGGCACTATGGTCACTGTGTCCAGCGGAGGAGGC GGATCGGGAGGCGGCGGATCAGGGGGAGGCGGTTCCAGCTACGTGCTTACT CAACCCCCTTCGGTGTCCGTGGCCCCGGGACAGACCGCCAGAATCACTTGC GGAGGGAAACAACATTGGGTCCAAGAGCGTGCATTGGTACCAGCAGAAGCCA GGACAGGCCCCTGTGCTGGTGCTCTACGGGAAGAACAATCGGCCCAGCGGA GTGCCGGACAGGTTCTCGGGTTCACGCTCCGGTACAACCGCTTCACTGACT ATCACCGGGGCCCAGGCAGAGGATGAAGCGGACTACTACTGTTCCTCCCGG GATTCATCCGGCGACCACCTCCGGGTGTTCGGAACCGGAACGAAGGTCACC GTGCTGACCACTACCCCAGCACCGAGGCCACCCACCCCGGCTCCTACCATC GCCTCCCAGCCTCTGTCCCTGCGTCCGGAGGCATGTAGACCCGCAGCTGGT GGGGCCGTGCATACCCGGGGTCTTGACTTCGCCTGCGATATCTACATTTGG GCCCCTCTGGCTGGTACTTGCGGGGTCCTGCTGCTTTCACTCGTGATCACT |

TABLE 23-continued

Exemplary BCMA CAR molecules. Sequences are provided with a leader sequence.

| Name/<br>Description | SEQ ID<br>NO: | Sequence |
|---|---|---|
| | | CTTTACTGTAAGCGCGGTCGGAAGAAGCTGCTGTACATCTTTAAGCAACCC<br>TTCATGAGGCCTGTGCAGACTACTCAAGAGGAGGACGGCTGTTCATGCCGG<br>TTCCCAGAGGAGGAGGAAGGCGGCTGCGAACTGCGCGTGAAATTCAGCCGC<br>AGCGCAGATGCTCCAGCCTACAAGCAGGGGCAGAACCAGCTCTACAACGAA<br>CTCAATCTTGGTCGGAGAGAGGAGTACGACGTGCTGGACAAGCGGAGAGGA<br>CGGGACCCAGAAATGGGCGGGAAGCCGCGCAGAAAGAATCCCCAAGAGGGC<br>CTGTACAACGAGCTCCAAAAGGATAAGATGGCAGAAGCCTATAGCGAGATT<br>GGTATGAAAGGGGAACGCAGAAGAGGCAAAGGCCACGACGGACTGTACCAG<br>GGACTCAGCACCGCCACCAAGGACACCTATGACGCTCTTCACATGCAGGCC<br>CTGCCGCCTCGG |
| 149369 | | |
| 149369-aa<br>Full CAR | 8586 | MALPVTALLLPLALLLHAARPEVQLQQSGPGLVKPSQTLSLTCAISGDSVS<br>SNSAAWNWIRQSPSRGLEWLGRTYYRSKWYSFYAISLKSRIIINPDTSKNQ<br>FSLQLKSVTPEDTAVYYCARSSPEGLFLYWFDPWGQGTLVTVSSGGDGSGG<br>GGSGGGGSSSELTQDPAVSVALGQTIRITCQGDSLGNYYATWYQQKPGQAP<br>VLVIYGTNNRPSGIPDRFSASSSGNTASLTITGAQAEDEADYYCNSRDSSG<br>HHLLFGTGTKVTVLTTTPAPRPPTPAPTIASQPLSLRPEACRPAAGGAVHT<br>RGLDFACDIYIWAPLAGTCGVLLLSLVITLYCKRGRKKLLYIFKQPFMRPV<br>QTTQEEDGCSCRFPEEEEGGCELRVKFSRSADAPAYKQGQNQLYNELNLGR<br>REEYDVLDKRRGRDPEMGGKPRRKNPQEGLYNELQKDKMAEAYSEIGMKGE<br>RRRGKGHDGLYQGLSTATKDTYDALHMQALPPR |
| 149369-nt<br>Full CAR | 8608 | ATGGCCCTCCCTGTCACCGCCCTGCTGCTTCCGCTGGCTCTTCTGCTCCAC<br>GCCGCTCGGCCCGAAGTGCAGCTCCAACAGTCAGGACCGGGGCTCGTGAAG<br>CCATCCCAGACCCTGTCCCTGACTTGTGCCATCTCGGGAGATAGCGTGTCA<br>TCGAACTCCGCCGCCTGGAACTGGATTCGGCAGAGCCCGTCCCGCGGACTG<br>GAGTGGCTTGGAAGGACCTACTACCGGTCCAAGTGGTACTCTTTCTACGCG<br>ATCTCGCTGAAGTCCCGCATTATCATTAACCCTGATACCTCCAAGAATCAG<br>TTCTCCCTCCAACTGAAATCCGTCACCCCCGAGGACACAGCAGTGTATTAC<br>TGCGCACGGAGCAGCCCCGAAGGACTGTTCCTGTATTGGTTTGACCCCTGG<br>GGCCAGGGGACTCTTGTGACCGTGTCGAGCGGCGGAGATGGGTCCGGTGGC<br>GGTGGTTCGGGGGGCGGCGGATCATCATCCGAACTGACCCAGGACCCGGCT<br>GTGTCCGTGGCGCTGGGACAAACCATCCGCATTACGTGCCAGGGAGACTCC<br>CTGGGCAACTACTACGCCACTTGGTACCAGCAGAAGCCGGGCCAAGCCCCT<br>GTGTTGGTCATCTACGGGACCAACAACAGACCTTCCGGCATCCCCGACCGG<br>TTCAGCGCTTCGTCCTCCGGCAACACTGCCAGCCTGACCATCACTGGAGCG<br>CAGGCCGAAGATGAGGCCGACTACTACTGCAACAGCAGAGACTCCTCGGGT<br>CATCACCTCTTGTTCGGAACTGGAACCAAGGTCACCGTGCTGACCACTACC<br>CCAGCACCGAGGCCACCCACCCCGGCTCCTACCATCGCCTCCCAGCCTCTG<br>TCCCTGCGTCCGGAGGCATGTAGACCCGCAGCTGGTGGGGCCGTGCATACC<br>CGGGGTCTTGACTTCGCCTGCGATATCTACATTTGGGCCCCTCTGGCTGGT<br>ACTTGCGGGGTCCTGCTGCTTTCACTCGTGATCACTCTTTACTGTAAGCGC<br>GGTCGGAAGAAGCTGCTGTACATCTTTAAGCAACCCTTCATGAGGCCTGTG<br>CAGACTACTCAAGAGGAGGACGGCTGTTCATGCCGGTTCCCAGAGGAGGAG<br>GAAGGCGGCTGCGAACTGCGCGTGAAATTCAGCCGCAGCGCAGATGCTCCA<br>GCCTACAAGCAGGGGCAGAACCAGCTCTACAACGAACTCAATCTTGGTCGG<br>AGAGAGGAGTACGACGTGCTGGACAAGCGGAGAGGACGGGACCCAGAAATG<br>GGCGGGAAGCCGCGCAGAAAGAATCCCCAAGAGGGCCTGTACAACGAGCTC<br>CAAAAGGATAAGATGGCAGAAGCCTATAGCGAGATTGGTATGAAAGGGGAA<br>CGCAGAAGAGGCAAAGGCCACGACGGACTGTACCAGGGACTCAGCACCGCC<br>ACCAAGGACACCTATGACGCTCTTCACATGCAGGCCCTGCCGCCTCGG |
| BCMA_EBB-<br>C1978-A4 | | |
| BCMA_EBB-<br>C1978-A4-<br>aa<br>Full CAR | 8587 | MALPVTALLLPLALLLHAARPEVQLVESGGGLVQPGGSLRLSCAASGFTFS<br>SYAMSWVRQAPGKGLEWVSAISGSGGSTYYADSVKGRFTISRDNSKNTLYL<br>QMNSLRAEDTAVYYCAKVEGSGSLDYWGQGTLVTVSSGGGGSGGGGSGGGG<br>SEIVMTQSPGTLSLSPGERATLSCRASQSVSSAYLAWYQQKPGQPPRLLIS<br>GASTRATGIPDRFGGSGSGTDFTLTISRLEPEDFAVYYCQHYGSSFNGSSL<br>FTFGQGTRLEIKTTTPAPRPPTPAPTIASQPLSLRPEACRPAAGGAVHTRG<br>LDFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRRE<br>EYDVLDKRRGRDPEMGGKPRRKNPQEGLYNELQKDKMAEAYSEIGMKGERR<br>RGKGHDGLYQGLSTATKDTYDALHMQALPPR |
| BCMA_EBB-<br>C1978-A4-<br>nt<br>Full CAR | 8609 | ATGGCCCTCCCTGTCACCGCCCTGCTGCTTCCGCTGGCTCTTCTGCTCCAC<br>GCCGCTCGGCCCGAAGTGCAGCTCGTGGAGTCAGGAGGCGGCCTGGTCCAG<br>CCGGGAGGGTCCCTTAGACTGTCATGCGCCGCAAGCGGATTCACTTTCTCC<br>TCCTATGCCATGAGCTGGGTCCGCCAAGCCCCCGGAAAGGGACTGGAATGG<br>GTGTCCGCCATCTCGGGGTCTGGAGGCTCAACTTACTACGCTGACTCCGTG<br>AAGGGACGGTTCACCATTAGCCGCGACAACTCCAAGAACACCCTCTACCTC<br>CAAATGAACTCCCTGCGGGCCGAGGATACCGCCGTCTACTACTGCGCCAAA<br>GTGGAAGGTTCAGGATCGCTGGACTACTGGGGACAGGGTACTCTCGTGACC<br>GTGTCATCGGGCGGAGGAGGTTCCGGCGGTGGCGGCTCCGGCGGCGGAGGG |

TABLE 23-continued

Exemplary BCMA CAR molecules. Sequences are provided with a leader sequence.

| Name/ Description | SEQ ID NO: | Sequence |
|---|---|---|
| | | TCGGAGATCGTGATGACCCAGAGCCCTGGTACTCTGAGCCTTTCGCCGGGA GAAAGGGCCACCCTGTCCTGCCGCGCTTCCCAATCCGTGTCCTCCGCGTAC TTGGCGTGGTACCAGCAGAAGCCGGGACAGCCCCTCGGCTGCTGATCAGC GGGGCCAGCACCCGGGCAACCGGAATCCCAGACAGATTCGGGGGTTCCGGC AGCGGCACAGATTTCACCCTGACTATTTCGAGGTTGGAGCCCGAGGACTTT GCGGTGTATTACTGTCAGCACTACGGGTCGTCCTTTAATGGCTCCAGCCTG TTCACGTTCGGACAGGGGACCCGCCTGGAAATCAAGACCACTACCCCAGCA CCGAGGCCACCCACCCCGGCTCCTACCATCGCCTCCCAGCCTCTGTCCCTG CGTCCGGAGGCATGTAGACCCGCAGCTGGTGGGGCCGTGCATACCCGGGGT CTTGACTTCGCCTGCGATATCTACATTTGGGCCCCTCTGGCTGGTACTTGC GGGGTCCTGCTGCTTTCACTCGTGATCACTCTTTACTGTAAGCGCGGTCGG AAGAAGCTGCTGTACATCTTTAAGCAACCCTTCATGAGGCCTGTGCAGACT ACTCAAGAGGAGGACGGCTGTTCATGCCGGTTCCCAGAGGAGGAGGAAGGC GGCTGCGAACTGCGCGTGAAATTCAGCCGCAGCGCAGATGCTCCAGCCTAC AAGCAGGGGCAGAACCAGCTCTACAACGAACTCAATCTTGGTCGGAGAGAG GAGTACGACGTGCTGGACAAGCGGAGAGGACGGGACCCAGAAATGGGCGGG AAGCCGCGCAGAAAGAATCCCCAAGAGGGCCTGTACAACGAGCTCCAAAAG GATAAGATGGCAGAAGCCTATAGCGAGATTGGTATGAAAGGGGAACGCAGA AGAGGCAAAGGCCACGACGGACTGTACCAGGGACTCAGCACCGCCACCAAG GACACCTATGACGCTCTTCACATGCAGGCCCTGCCGCCTCGG |
| BCMA_EBB-C1978-G1 | | |
| BCMA_EBB-C1978-G1-aa Full CAR | 8588 | MALPVTALLLPLALLLHAARPEVQLVETGGGLVQPGGSLRLSCAASGITFS RYPMSWVRQAPGKGLEWVSGISDSGVSTYYADSAKGRFTISRDNSKNTLFL QMSSLRDEDTAVYYCVTRAGSEASDIWGQGTMVTVSSGGGGSGGGGSGGGG SEIVLTQSPATLSLSPGERATLSCRASQSVSNSLAWYQQKPGQAPRLLIYD ASSRATGIPDRFSGSGSGTDFTLTISRLEPEDFAIYYCQQFGTSSGLTFGG GTKLEIKTTTPAPRPPTPAPTIASQPLSLRPEACRPAAGGAVHTRGLDFAC DIYIWAPLAGTCGVLLLSLVITLYCKRGRKKLLYIFKQPFMRPVQTTQEED GCSCRFPEEEEGGCELRVKFSRSADAPAYKQGQNQLYNELNLGRREEYDVL DKRRGRDPEMGGKPRRKNPQEGLYNELQKDKMAEAYSEIGMKGERRRGKGH DGLYQGLSTATKDTYDALHMQALPPR |
| BCMA_EBB-C1978-G1-nt Full CAR | 8610 | ATGGCCCTCCCTGTCACCGCCCTGCTGCTTCCGCTGGCTCTTCTGCTCCAC GCCGCTCGGCCCGAAGTGCAACTGGTGGAAACCGGTGGCGGCCTGGTGCAG CCTGGAGGATCATTGAGGCTGTCATGCGCGGCCAGCGGTATTACCTTCTCC CGGTACCCCATGTCCTGGGTCAGACAGGCCCCGGGGAAAGGGCTTGAATGG GTGTCCGGGATCTCGGACTCCGGTGTCAGCACTTACTACGCCGACTCCGCC AAGGGACGCTTCACCATTTCCCGGGACAACTCGAAGAACACCCTGTTCCTC CAAATGAGCTCCCTCCGGGACGAGGATACTGCAGTGTACTACTGCGTGACC CGCGCCGGGTCCGAGGCGTCTGACATTTGGGGACAGGGCACTATGGTCACC GTGTCGTCCGGCGGAGGGGGCTCGGGAGGCGGTGGCAGCGGAGGAGGAGGG TCCGAGATCGTGCTGACCCAATCCCCGGCCACCCTCTCGCTGAGCCCTGGA GAAAGGGCAACCTTGTCCTGTCGCGCGAGCCAGTCCGTGAGCAACTCCCTG GCCTGGTACCAGCAGAAGCCCGGACAGGCTCCGAGACTTCTGATCTACGAC GCTTCGAGCCGGGCCACTGGAATCCCCGACCGCTTTTCGGGGTCCGGCTCA GGAACCGATTTCACCCTGACAATCTCACGGCTGGAGCCAGAGGATTTCGCC ATCTATTACTGCCAGCAGTTCGGTACTTCCTCCGGCCTGACTTTCGGAGGC GGCACGAAGCTGAAATCAAGACCACTACCCCAGCACCGAGGCCACCCACC CCGGCTCCTACCATCGCCTCCCAGCCTCTGTCCCTGCTCCGGAGGCATGT AGACCCGCAGCTGGTGGGGCCGTGCATACCCGGGGTCTTGACTTCGCCTGC GATATCTACATTTGGGCCCCTCTGGCTGGTACTTGCGGGGTCCTGCTGCTT TCACTCGTGATCACTCTTTACTGTAAGCGCGGTCGGAAGAAGCTGCTGTAC ATCTTTAAGCAACCCTTCATGAGGCCTGTGCAGACTACTCAAGAGGAGGAC GGCTGTTCATGCCGGTTCCCAGAGGAGGAGGAAGGCGGCTGCGAACTGCGC GTGAAATTCAGCCGCAGCGCAGATGCTCCAGCCTACAAGCAGGGGCAGAAC CAGCTCTACAACGAACTCAATCTTGGTCGGAGAGAGGAGTACGACGTGCTG GACAAGCGGAGAGGACGGGACCCAGAAATGGGCGGGAAGCCGCGCAGAAAG AATCCCCAAGAGGGCCTGTACAACGAGCTCCAAAAGGATAAGATGGCAGAA GCCTATAGCGAGATTGGTATGAAAGGGGAACGCAGAAGAGGCAAAGGCCAC GACGGACTGTACCAGGGACTCAGCACCGCCACCAAGGACACCTATGACGCT CTTCACATGCAGGCCCTGCCGCCTCGG |
| BCMA_EBB-C1979-C1 | | |
| BCMA_EBB-C1979-C1-aa Full CAR | 8589 | MALPVTALLLPLALLLHAARPQVQLVESGGGLVQPGGSLRLSCAASGFTFS SYAMSWVRQAPGKGLEWVSAISGSGGSTYYADSVKGRFTISRDNAKNSLYL QMNSLRAEDTAIYYCARATYKRELRYYYGMDVWGQGTMVTVSSGGGGSGGG GSGGGGSEIVMTQSPGTVSLSPGERATLSCRASQSVSSSFLAWYQQKPGQA PRLLIYGASSRATGIPDRFSGSGSGTDFTLTISRLEPEDSAVYYCQQYHSS PSWTFGQGTRLEIKTTTPAPRPPTPAPTIASQPLSLRPEACRPAAGGAVHT RGLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNLGR |

TABLE 23-continued

Exemplary BCMA CAR molecules. Sequences are provided with a leader sequence.

| Name/<br>Description | SEQ ID<br>NO: | Sequence |
|---|---|---|
| | | REEYDVLDKRRGRDPEMGGKPRRKNPQEGLYNELQKDKMAEAYSEIGMKGE<br>RRRGKGHDGLYQGLSTATKDTYDALHMQALPPR |
| BCMA_EBB-<br>C1979-C1-<br>nt<br>Full CAR | 8611 | ATGGCCCTCCCTGTCACCGCCCTGCTGCTTCCGCTGGCTCTTCTGCTCCAC<br>GCCGCTCGGCCCCAAGTGCAGCTCGTGGAATCGGGTGGCGGACTGGTGCAG<br>CCGGGGGGCTCACTTAGACTGTCCTGCGCGGCCAGCGGATTCACTTTCTCC<br>TCCTACGCCATGTCCTGGGTCAGACAGGCCCCTGGAAAGGGCCTGGAATGG<br>GTGTCCGCAATCAGCGGCAGCGGCGGCTCGACCTATTACGCGGATTCAGTG<br>AAGGGCAGATTCACCATTTCCCGGGACAACGCCAAGAACTCCTTGTACCTT<br>CAAATGAACTCCCTCCGCGCGGAAGATACCGCAATCTACTACTGCGCTCGG<br>GCCACTTACAAGAGGGAACTGCGCTACTACTACGGGATGGACGTCTGGGGC<br>CAGGGAACCATGGTCACCGTGTCCAGCGGAGGAGGAGGATCGGGAGGAGGC<br>GGTAGCGGGGGTGGAGGGTCGGAGATCGTGATGACCCAGTCCCCCGGCACT<br>GTGTCGCTGTCCCCCGGCGAACGGGCCACCCTGTCATGTCGGGCCAGCCAG<br>TCAGTGTCGTCAAGCTTCCTCGCCTGGTACCAGCAGAAACCGGGACAAGCT<br>CCCCGCCTGCTGATCTACGGAGCCAGCAGCCGGGCCACCGGTATTCCTGAC<br>CGGTTCTCCGGTTCGGGGTCCGGGACCGACTTTACTCTGACTATCTCTCGC<br>CTCGAGCCAGAGGACTCCGCCGTGTATTACTGCCAGCAGTACCACTCCTCC<br>CCGTCCTGGACGTTCGGACAGGGCACAAGGCTGGAGATTAAGACCACTACC<br>CCAGCACCGAGGCCACCCACCCCGGCTCCTACCATCGCCTCCCAGCCTCTG<br>TCCCTGCGTCCGGAGGCATGTAGACCCGCAGCTGGTGGGGCCGTGCATACC<br>CGGGGTCTTGACTTCGCCTGCGATATCTACATTTGGGCCCCTCTGGCTGGT<br>ACTTGCGGGGTCCTGCTGCTTTCACTCGTGATCACTCTTTACTGTAAGCGC<br>GGTCGGAAGAAGCTGCTGTACATCTTTAAGCAACCCTTCATGAGGCCTGTG<br>CAGACTACTCAAGAGGAGGACGGCTGTTCATGCCGGTTCCCAGAGGAGGAG<br>GAAGGCGGCTGCGAACTGCGCGTGAAATTCAGCCGCAGCGCAGATGCTCCA<br>GCCTACAAGCAGGGGCAGAACCAGCTCTACAACGAACTCAATCTTGGTCGG<br>AGAGAGGAGTACGACGTGCTGGACAAGCGGAGAGGACGGGACCCAGAAATG<br>GGCGGGAAGCCGCGCAGAAAGAATCCCCAAGAGGGCCTGTACAACGAGCTC<br>CAAAAGGATAAGATGGCAGAAGCCTATAGCGAGATTGGTATGAAAGGGGAA<br>CGCAGAAGAGGCAAAGGCCACGACGGACTGTACCAGGGACTCAGCACCGCC<br>ACCAAGGACACCTATGACGCTCTTCACATGCAGGCCCTGCCGCCTCGG |
| BCMA_EBB-<br>C1978-C7 | | |
| BCMA_EBB-<br>C1978-C7-<br>aa<br>Full CAR | 8590 | MALPVTALLLPLALLLHAARPEVQLVETGGGLVQPGGSLRLSCAASGFTFS<br>SYAMSWVRQAPGKGLEWVSAISGSGGSTYYADSVKGRFTISRDNSKNTLYL<br>QMNTLKAEDTAVYYCARATYKRELRYYYGMDVWGQGTTVTVSSGGGGSGGG<br>GSGGGGSEIVLTQSPSTLSLSPGESATLSCRASQSVSTTFLAWYQQKPGQA<br>PRLLIYGSSNRATGIPDRFSGSGSGTDFTLTIRRLEPEDFAVYYCQQYHSS<br>PSWTFGQGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPV<br>QTTQEEDGCSCRFPEEEEGGCELRVKFSRSADAPAYKQGQNQLYNELNLGR<br>REEYDVLDKRRGRDPEMGGKPRRKNPQEGLYNELQKDKMAEAYSEIGMKGE<br>RRRGKGHDGLYQGLSTATKDTYDALHMQALPPR |
| BCMA_EBB-<br>C1978-C7-<br>nt<br>Full CAR | 8612 | ATGGCCCTCCCTGTCACCGCCCTGCTGCTTCCGCTGGCTCTTCTGCTCCAC<br>GCCGCTCGGCCCGAGGTGCAGCTTGTGGAAACCGGTGGCGGACTGGTGCAG<br>CCCGGAGGAAGCCTCAGGCTGTCCTGCGCCGCGTCCGGCTTCACCTTCTCC<br>TCGTACGCCATGTCCTGGGTCCGCCAGGCCCCCGGAAAGGGCCTGGAATGG<br>GTGTCCGCCATCTCTGGAAGCGGAGGTTCCACGTACTACGCGGACAGCGTC<br>AAGGGAAGGTTCACAATCTCCCGCGATAATTCGAAGAACACTCTGTACCTT<br>CAAATGAACACCCTGAAGGCCGAGGACACTGCTGTGTACTACTGCGCACGG<br>GCCACCTACAAGAGAGAGCTCCGGTACTACTACGGGAATGGACGTCTGGGGC<br>CAGGGAACTACTGTGACCGTGTCCTCGGGAGGGGGTGGCTCCGGGGGGGGC<br>GGCTCCGGCGGAGGCGGTTCCGAGATTGTGCTGACCCAGTCACCTTCAACT<br>CTGTCGCTGTCCCGGGAGAGAGCGCTACTCTGAGCTGCCGGGCCAGCCAG<br>TCCGTGTCCACCACCTTCCTCGCCTGGTATCAGCAGAAGCCGGGCAGGCA<br>CCACGGCTCTTGATCTACGGGTCAAGCAACAGAGCGACCGGAATTCCTGAC<br>CGCTTCTCGGGGAGCGGTTCAGGCACCGACTTCACCCTGACTATCCGGCGC<br>CTGGAACCCGAAGATTTCGCCGTGTATTACTGTCAACAGTACCACTCCTCG<br>CCGTCCTGGACCTTTGGCCAAGGAACCAAAGTGGAAATCAAGACCACTACC<br>CCAGCACCGAGGCCACCCACCCCGGCTCCTACCATCGCCTCCCAGCCTCTG<br>TCCCTGCGTCCGGAGGCATGTAGACCCGCAGCTGGTGGGGCCGTGCATACC<br>CGGGGTCTTGACTTCGCCTGCGATATCTACATTTGGGCCCCTCTGGCTGGT<br>ACTTGCGGGGTCCTGCTGCTTTCACTCGTGATCACTCTTTACTGTAAGCGC<br>GGTCGGAAGAAGCTGCTGTACATCTTTAAGCAACCCTTCATGAGGCCTGTG<br>CAGACTACTCAAGAGGAGGACGGCTGTTCATGCCGGTTCCCAGAGGAGGAG<br>GAAGGCGGCTGCGAACTGCGCGTGAAATTCAGCCGCAGCGCAGATGCTCCA<br>GCCTACAAGCAGGGGCAGAACCAGCTCTACAACGAACTCAATCTTGGTCGG<br>AGAGAGGAGTACGACGTGCTGGACAAGCGGAGAGGACGGGACCCAGAAATG<br>GGCGGGAAGCCGCGCAGAAAGAATCCCCAAGAGGGCCTGTACAACGAGCTC<br>CAAAAGGATAAGATGGCAGAAGCCTATAGCGAGATTGGTATGAAAGGGGAA<br>CGCAGAAGAGGCAAAGGCCACGACGGACTGTACCAGGGACTCAGCACCGCC<br>ACCAAGGACACCTATGACGCTCTTCACATGCAGGCCCTGCCGCCTCGG |

TABLE 23-continued

Exemplary BCMA CAR molecules. Sequences are provided with a leader sequence.

| Name/ Description | SEQ ID NO: | Sequence |
|---|---|---|
| BCMA_EBB-C1978-D10 | | |
| BCMA_EBB-C1978-D10-aa Full CAR | 8591 | MALPVTALLLPLALLLHAARPEVQLVETGGGLVQPGRSLRLSCAASGFTFD DYAMHWVRQAPGKGLEWVSGISWNSGSIGYADSVKGRFTISRDNAKNSLYL QMNSLRDEDTAVYYCARVGKAVPDVWGQGTTVTVSSGGGGSGGGGSGGGGS DIVMTQTPSSLSASVGDRVTITCRASQSISSYLNWYQQKPGKAPKLLIYAA SSLQSGVPSRFSGSGSGTDFTLTISSLQPEDFATYYCQQSYSTPYSFGQGT RLEIKTTTPAPRPPTPAPTIASQPLSLRPEACRPAAGGAVHTRGLDFACDI YIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDK RRGRDPEMGGKPRRKNPQEGLYNELQKDKMAEAYSEIGMKGERRRGKGHDG LYQGLSTATKDTYDALHMQALPPR |
| BCMA_EBB-C1978-D10-nt Full CAR | 8613 | ATGGCCCTCCCTGTCACCGCCCTGCTGCTTCCGCTGGCTCTTCTGCTCCAC GCCGCTCGGCCCGAAGTGCAGCTCGTGGAAACTGGAGGTGGACTCGTGCAG CCTGGACGGTCGCTGCGGCTGAGCTGCGCTGCATCCGGCTTCACCTTCGAC GATTATGCCATGCACTGGGTCAGACAGGCGCCAGGGAAGGGACTTGAGTGG GTGTCCGGTATCAGCTGGAATAGCGGCTCAATCGGATACGCGGACTCCGTG AAGGGAAGGTTCACCATTTCCCGCGACAACGCCAAGAACTCCCTGTACTTG CAAATGAACAGCCTCCGGGATGAGGACACTGCCGTGTACTACTGCGCCCGC GTCGGAAAAGCTGTGCCCGACGTCTGGGGCCAGGGAACCACTGTGACCGTG TCCAGCGGCGGGGGTGGATCGGGCGGTGGAGGGTCCGGTGGAGGGGGCTCA GATATTGTGATGACCCAGACCCCCTCGTCCCTGTCCGCCTCGGTCGGCGAC CGCGTGACTATCACATGTAGAGCCTCGCAGAGCATCTCCAGCTACCTGAAC TGGTATCAGCAGAAGCCGGGGAAGGCCCCGAAGCTCCTGATCTACGCGGCA TCATCACTGCAATCGGGAGTGCCGAGCCGGTTTTCCGGGTCCGGCTCCGGC ACCGACTTCACGCTGACCATTTCTTCCCTGCAACCCGAGGACTTCGCCACT TACTACTGCCAGCAGTCCTACTCCACCCCTTACTCCTTCGGCCAAGGAACC AGGCTGGAAATCAAGACCACTACCCCAGCACCGAGGCCACCCACCCCGGCT CCTACCATCGCCTCCCAGCCTCTGTCCCTGCGTCCGGAGGCATGTAGACCC GCAGCTGGTGGGGCCGTGCATACCCGGGGTCTTGACTTCGCCTGCGATATC TACATTTGGGCCCCTCTGGCTGGTACTTGCGGGGTCCTGCTGCTTTCACTC GTGATCACTCTTTACTGTAAGCGCGGTCGGAAGAAGCTGCTGTACATCTTT AAGCAACCCTTCATGAGGCCTGTGCAGACTACTCAAGAGGAGGACGGCTGT TCATGCCGGTTCCCAGAGGAGGAGGAAGGCGGCTGCGAACTGCGCGTGAAA TTCAGCCGCAGCGCAGATGCTCCAGCCTACAAGCAGGGGCAGAACCAGCTC TACAACGAACTCAATCTTGGTCGGAGAGAGGAGTACGACGTGCTGGACAAG CGGAGAGGACGGGACCCAGAAATGGGCGGGAAGCCGCGCAGAAAGAATCCC CAAGAGGGCCTGTACAACGAGCTCCAAAAGGATAAGATGGCAGAAGCCTAT AGCGAGATTGGTATGAAAGGGGAACGCAGAAGAGGCAAAGGCCACGACGGA CTGTACCAGGGACTCAGCACCGCCACCAAGGACACCTATGACGCTCTTCAC ATGCAGGCCCTGCCGCCTCGG |
| BCMA_EBB-C1979-C12 | | |
| BCMA_EBB-C1979-C12-aa Full CAR | 8592 | MALPVTALLLPLALLLHAARPEVQLVESGGGLVQPGRSLRLSCTASGFTFD DYAMHWVRQRPGKGLEWVASINWKGNSLAYGDSVKGRFAISRDNAKNTVFL QMNSLRTEDTAVYYCASHQGVAYYNYAMDVWGRGTLVTVSSGGGGSGGGGS GGGGSEIVLTQSPGTLSLSPGERATLSCRATQSIGSSFLAWYQQRPGQAPR LLIYGASQRATGIPDRFSGRGSGTDFTLTISRVEPEDSAVYYCQHYESSPS WTFGQGTKVEIKTTTPAPRPPTPAPTIASQPLSLRPEACRPAAGGAVHTRG LDFACDIYIWAPLAGTCGVLLLSLVITLYCKRGRKKLLYIFKQPFMRPVQT TQEEDGCSCRFPEEEEGGCELRVKFSRSADAPAYKQGQNQLYNELNLGRRE EYDVLDKRRGRDPEMGGKPRRKNPQEGLYNELQKDKMAEAYSEIGMKGERR RGKGHDGLYQGLSTATKDTYDALHMQALPPR |
| BCMA_EBB-C1979-C12-nt Full CAR | 8614 | ATGGCCCTCCCTGTCACCGCCCTGCTGCTTCCGCTGGCTCTTCTGCTCCAC GCCGCTCGGCCCGAAGTGCAGCTCGTGGAGAGCGGGGGAGGATTGGTGCAG CCCGGAAGGTCCCTGCGGCTCTCCTGCACTGCGTCTGGCTTCACCTTCGAC GACTACGCGATGCACTGGGTCAGACAGCGCCCGGGAAAGGGCCTGGAATGG GTCGCCTCAATCAACTGGAAGGGAAACTCCCTGGCCTATGGCGACAGCGTG AAGGGCCGCTTCGCCATTTCGCGCGACAACGCCAAGAACACCGTGTTTCTG CAAATGAATTCCCTGCGGACCGAGGATACCGCTGTGTACTACTGCGCCAGC CACCAGGGCGTGGCATACTATAACTACGCCATGGACGTGTGGGGAAGAGGG ACGCTCGTCACCGTGTCCTCCGGGGGCGGTGGATCGGGTGGAGGAGGAAGC GGTGGCGGGGGCAGCGAAATCGTGCTGACTCAGAGCCCGGGAACTCTTTCA CTGTCCCCGGGAGAACGGGCCACTCTCTCGTGCCGGGCCACCCAGTCCATC GGCTCCTCCTTCCTTGCCTGGTACCAGCAGAGGCCAGGACAGGCGCCCCGC CTGCTGATCTACGGTGCTTCCCAACGCGCCACTGGCATTCCTGACCGGTTC AGCGGCAGAGGGTCGGGAACCGATTTCACACTGACCATTTCCCGGGTGGAG CCCGAAGATTCGGCAGTCTACTACTGTCAGCATTACGAGTCCTCCCCTTCA TGGACCTTCGGTCAAGGGACCAAAGTGGAGATCAAGACCACTACCCCAGCA CCGAGGCCACCCACCCCGGCTCCTACCATCGCCTCCCAGCCTCTGTCCCTG CGTCCGGAGGCATGTAGACCCGCAGCTGGTGGGGCCGTGCATACCCGGGGT CTTGACTTCGCCTGCGATATCTACATTTGGGCCCCTCTGGCTGGTACTTGC |

TABLE 23-continued

Exemplary BCMA CAR molecules. Sequences are provided with a leader sequence.

| Name/<br>Description | SEQ ID<br>NO: | Sequence |
|---|---|---|
| | | GGGGTCCTGCTGCTTTCACTCGTGATCACTCTTTACTGTAAGCGCGGTCGG<br>AAGAAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAAGGC<br>GGCTGCGAACTGCGCGTGAAATTCAGCCGCAGCGCAGATGCTCCAGCCTAC<br>AAGCAGGGGCAGAACCAGCTCTACAACGAACTCAATCTTGGTCGGAGAGAG<br>GAGTACGACGTGCTGGACAAGCGGAGAGGACGGGACCCAGAAATGGGCGGG<br>AAGCCGCGCAGAAAGAATCCCCAAGAGGGCCTGTACAACGAGCTCCAAAAG<br>GATAAGATGGCAGAAGCCTATAGCGAGATTGGTATGAAAGGGGAACGCAGA<br>AGAGGCAAAGGCCACGACGGACTGTACCAGGGACTCAGCACCGCCACCAAG<br>GACACCTATGACGCTCTTCACATGCAGGCCCTGCCGCCTCGG |
| BCMA_EBB-<br>C1980-G4 | | |
| BCMA_EBB-<br>C1980-G4-<br>aa<br>Full CAR | 8593 | MALPVTALLLPLALLLHAARPEVQLVESGGGLVQPGGSLRLSCAASGFTFS<br>SYAMSWVRQAPGKGLEWVSAISGSGGSTYYADSVKGRFTISRDNSKNTLYL<br>QMNSLRAEDTAVYYCAKVVRDGMDVWGQGTTVTVSSGGGGSGGGGSGGGGS<br>EIVLTQSPATLSLSPGERATLSCRASQSVSSSYLAWYQQKPGQAPRLLIYG<br>ASSRATGIPDRFSGNGSGTDFTLTISRLEPEDFAVYYCQQYGSPPRFTFGP<br>GTKVDIKTTTPAPRPPTPAPTIASQPLSLRPEACRPAAGGAVHTRGLDFAC<br>DIYIWAPLAGTCGVLLLSLVITLYCKRGRKKLLYIFKQPFMRPVQTTQEED<br>GCSCRFPEEEEGGCELRVKFSRSADAPAYKQGQNQLYNELNLGRREEYDVL<br>DKRRGRDPEMGGKPRRKNPQEGLYNELQKDKMAEAYSEIGMKGERRRGKGH<br>DGLYQGLSTATKDTYDALHMQALPPR |
| BCMA_EBB-<br>C1980-G4-<br>nt<br>Full CAR | 8615 | ATGGCCCTCCCTGTCACCGCCCTGCTGCTTCCGCTGGCTCTTCTGCTCCAC<br>GCCGCTCGGCCCGAGGTGCAGTTGGTCGAAAGCGGGGGCGGGCTTGTGCAG<br>CCTGGCGGATCACTGCGGCTGTCCTGCGCGGCATCAGGCTTCACGTTTCT<br>TCCTACGCCATGTCCTGGGTGCGCCAGGCCCCTGGAAAGGGACTGGAATGG<br>GTGTCCGCGATTTCGGGGTCCGGCGGGAGCACCTACTACGCCGATTCCGTG<br>AAGGGCCGCTTCACTATCTCGCGGGACAACTCCAAGAACACCCTCTACCTC<br>CAAATGAATAGCCTGCGGGCCGAGGATACCGCCGTCTACTATTGCGCTAAG<br>GTCGTGCGCGACGGAATGGACGTGTGGGGACAGGGTACCACCGTGACAGTG<br>TCCTCGGGGGGAGGCGGTAGCGGCGGAGGAGGAAGCGGTGGTGGAGGTTCC<br>GAGATTGTGCTGACTCAATCACCCGCGACCCTGAGCCTGTCCCCCGGCGAA<br>AGGGCCACTCTGTCCTGTCGGGCCAGCCAATCAGTCTCCTCCTCGTACCTG<br>GCCTGGTACCAGCAGAAGCCAGGACAGGCTCCGAGACTCCTTATCTATGGC<br>GCATCCTCCCGCGCCACCGGAATCCCGGATAGGTTCTCGGGAAACGGATCG<br>GGGACCGACTTCACTCTCACCATCTCCCGGCTGGAACCGGAGGACTTCGCC<br>GTGTACTACTGCCAGCAGTACGGCAGCCCGCCTAGATTCACTTTCGGCCCC<br>GGCACCAAAGTGGACATCAAGACCACTACCCCAGCACCGAGGCCACCCACC<br>CCGGCTCCTACCATCGCCTCCCAGCCTCTGTCCCTGCGTCCGGAGGCATGT<br>AGACCCGCAGCTGGTGGGGCCGTGCATACCCGGGGTCTTGACTTCGCCTGC<br>GATATCTACATTTGGGCCCCTCTGGCTGGTACTTGCGGGGTCCTGCTGCTT<br>TCACTCGTGATCACTCTTTACTGTAAGCGCGGTCGGAAGAAGCTGCTGTAC<br>ATCTTTAAGCAACCCTTCATGAGGCCTGTGCAGACTACTCAAGAGGAGGAC<br>GGCTGTTCATGCCGGTTCCCAGAGGAGGAGGAAGGCGGCTGCGAACTGCGC<br>GTGAAATTCAGCCGCAGCGCAGATGCTCCAGCCTACAAGCAGGGGCAGAAC<br>CAGCTCTACAACGAACTCAATCTTGGTCGGAGAGAGGAGTACGACGTGCTG<br>GACAAGCGGAGAGGACGGGACCCAGAAATGGGCGGGAAGCCGCGCAGAAAG<br>AATCCCCAAGAGGGCCTGTACAACGAGCTCCAAAAGGATAAGATGGCAGAA<br>GCCTATAGCGAGATTGGTATGAAAGGGGAACGCAGAAGAGGCAAAGGCCAC<br>GACGGACTGTACCAGGGACTCAGCACCGCCACCAAGGACACCTATGACGCT<br>CTTCACATGCAGGCCCTGCCGCCTCGG |
| BCMA_EBB-<br>C1980-D2 | | |
| BCMA_EBB-<br>C1980-D2-<br>aa<br>Full CAR | 8594 | MALPVTALLLPLALLLHAARPEVQLLESGGGLVQPGGSLRLSCAASGFTFS<br>SYAMSWVRQAPGKGLEWVSAISGSGGSTYYADSVKGRFTISRDNSKNTLYL<br>QMNSLRAEDTAVYYCAKIPQTGTFDYWGQGTLVTVSSGGGGSGGGGSGGGG<br>SEIVLTQSPGTLSLSPGERATLSCRASQSVSSSYLAWYQQRPGQAPRLLIY<br>GASSRATGIPDRFSGSGSGTDFTLTISRLEPEDFAVYYCQHYGSSPSWTFG<br>QGTRLEIKTTTPAPRPPTPAPTIASQPLSLRPEACRPAAGGAVHTRGLDFA<br>CDIYIWAPLAGTCGVLLLSLVITLYCKRGRKKLLYIFKQPFMRPVQTTQEE<br>DGCSCRFPEEEEGGCELRVKFSRSADAPAYKQGQNQLYNELNLGRREEYDV<br>LDKRRGRDPEMGGKPRRKNPQEGLYNELQKDKMAEAYSEIGMKGERRRGKG<br>HDGLYQGLSTATKDTYDALHMQALPPR |
| BCMA_EBB-<br>C1980-D2-<br>nt<br>Full CAR | 8616 | ATGGCCCTCCCTGTCACCGCCCTGCTGCTTCCGCTGGCTCTTCTGCTCCAC<br>GCCGCTCGGCCCGAAGTGCAGCTGCTGGAGTCCGGCGGTGGATTGGTGCAA<br>CCGGGGGGATCGCTCAGACTGTCCTGTGCGGCGTCAGGCTTCACCTTCTCG<br>AGCTACGCCATGTCATGGGTCAGACAGGCCCCTGGAAAGGGTCTGGAATGG<br>GTGTCCGCCATTTCCGGGAGCGGGGATCTACATACTACGCCGATAGCGTG<br>AAGGGCCGCTTCACCATTTCCCGGGACAACTCCAAGAACACTCTCTATCTG<br>CAAATGAACTCCCTCCGCGCTGAGGACACTGCCGTGTACTACTGCGCCAAA<br>ATCCCTCAGACCGGCACCTTCGACTACTGGGGACAGGGGACTCTGGTCACC |

TABLE 23-continued

Exemplary BCMA CAR molecules. Sequences are provided with a leader sequence.

| Name/<br>Description | SEQ ID<br>NO: | Sequence |
|---|---|---|
| | | GTCAGCAGCGGTGGCGGAGGTTCGGGGGGAGGAGGAAGCGGCGGCGGAGGG<br>TCCGAGATTGTGCTGACCCAGTCACCCGGCACTTTGTCCCTGTCGCCTGGA<br>GAAAGGGCCACCCTTTCCTGCCGGGCATCCCAATCCGTGTCCTCCTCGTAC<br>CTGGCCTGGTACCAGCAGAGGCCCGGACAGGCCCCACGGCTTCTGATCTAC<br>GGAGCAAGCAGCCGCGCGACCGGTATCCCGGACCGGTTTTCGGGCTCGGGC<br>TCAGGAACTGACTTCACCCTCACCATCTCCCGCCTGGAACCCGAAGATTTC<br>GCTGTGTATTACTGCCAGCACTACGGCAGCTCCCCGTCCTGGACGTTCGGC<br>CAGGGAACTCGGCTGGAGATCAAGACCACTACCCCAGCACCGAGGCCACCC<br>ACCCCGGCTCCTACCATCGCCTCCCAGCCTCTGTCCCTGCGTCCGGAGGCA<br>TGTAGACCCGCAGCTGGTGGGGCCGTGCATACCCGGGGTCTTGACTTCGCC<br>TGCGATATCTACATTTGGGCCCCTCTGGCTGGTACTTGCGGGGTCCTGCTG<br>CTTTCACTCGTGATCACTCTTTACTGTAAGCGCGGTCGGAAGAAGCTGCTG<br>TACATCTTTAAGCAACCCTTCATGAGGCCTGTGCAGACTACTAAGAGGAG<br>GACGGCTGTTCATGCCGGTTCCCAGAGGAGGAGGAAGGCGGCTGCGAACTG<br>CGCGTGAAATTCAGCCGCAGCGCAGATGCTCCAGCCTACAAGCAGGGGCAG<br>AACCAGCTCTACAACGAACTCAATCTTGGTCGGAGAGAGGATACGACGTG<br>CTGGACAAGCGGAGAGGACGGGACCCAGAAATGGGCGGGAAGCCGCGCAGA<br>AAGAATCCCCAAGAGGGCCTGTACAACGAGCTCCAAAAGGATAAGATGGCA<br>GAAGCCTATAGCGAGATTGGTATGAAAGGGGAACGCAGAAGAGGCAAAGGC<br>CACGACGGACTGTACCAGGGACTCAGCACCGCCACCAAGGACACCTATGAC<br>GCTCTTCACATGCAGGCCCTGCCGCCTCGG |
| BCMA_EBB-<br>C1978-A10 | | |
| BCMA_EBB-<br>C1978-A10-<br>aa<br>Full CAR | 8595 | MALPVTALLLPLALLLHAARPEVQLVETGGGLVQPGGSLRLSCAASGFTFS<br>SYAMSWVRQAPGKGLEWVSAISGSGGSTYYADSVKGRFTMSRENDKNSVFL<br>QMNSLRVEDTGVYYCARANYKRELRYYYGMDVWGQGTMVTVSSGGGGSGGG<br>GSGGGGSEIVMTQSPGTLSLSPGESATLSCRASQRVASNYLAWYQHKPGQA<br>PSLLISGASSRATGVPDRFSGSGSGTDFTLAISRLEPEDSAVYYCQHYDSS<br>PSWTFGQGTKVEIKTTTPAPRPPTPAPTIASQPLSLRPEACRPAAGGAVHT<br>RGLDFACDIYIWAPLAGTCGVLLLSLVITLYCKRGRKKLLYIFKQPFMRPV<br>QTTQEEDGCSCRFPEEEEGGCELRVKFSRSADAPAYKQGQNQLYNELNLGR<br>REEYDVLDKRRGRDPEMGGKPRRKNPQEGLYNELQKDKMAEAYSEIGMKGE<br>RRRGKGHDGLYQGLSTATKDTYDALHMQALPPR |
| BCMA_EBB-<br>C1978-A10-<br>nt<br>Full CAR | 8617 | ATGGCCCTCCCTGTCACCGCCCTGCTGCTTCCGCTGGCTCTTCTGCTCCAC<br>GCCGCTCGGCCCGAAGTGCAACTGGTGGAAACCGGTGGAGGACTCGTGCAG<br>CCTGGCGGCAGCCTCCGGCTGAGCTGCGCCGCTTCGGGATTCACCTTTTCC<br>TCCTACGCGATGTCTTGGGTCAGACAGGCCCCCGGAAAGGGGCTGGAATGG<br>GTGTCAGCCATCTCCGGCTCCGGCGGATCAACGTACTACGCCGACTCCGTG<br>AAAGGCCGGTTCACCATGTCGCGCGAGAATGACAAGAACTCCGTGTTCCTG<br>CAAATGAACTCCCTGAGGGTGGAGGACACCGGAGTGTACTATTGTGCGCGC<br>GCCAACTACAAGAGAGAGCTGCGGTACTACTACGGAATGGACGTCTGGGGA<br>CAGGGAACTATGGTGACCGTGTCATCCGGTGGAGGGGGAAGCGGCGGTGGA<br>GGCAGCGGGGGCGGGGTTCAGAAATTGTCATGACCCAGTCCCCGGGAACT<br>CTTTCCCTCTCCCCGGGGAATCCGCGACTTTGTCCTGCCGGGCCAGCCAG<br>CGCGTGGCCTCGAACTACCTCGCATGGTACCAGCATAAGCCAGGCCAAGCC<br>CCTTCCCTGCTGATTTCCGGGGCTAGCAGCCGCGCCACTGGCGTGCCGGAT<br>AGGTTCTCGGGAAGCGGCTCGGGTACCGATTTCACCCTGGCAATCTCGCGG<br>CTGGAACCGGAGGATTCGGCCGTGTACTACTGCCAGCACTATGACTCATCC<br>CCCTCCTGGACATTCGGACAGGGCACCAAGGTCGAGATCAAGACCACTACC<br>CCAGCACCGAGGCCACCCACCCCGGCTCCTACCATCGCCTCCCAGCCTCTG<br>TCCCTGCGTCCGGAGGCATGTAGACCCGCAGCTGGTGGGGCCGTGCATACC<br>CGGGGTCTTGACTTCGCCTGCGATATCTACATTTGGGCCCCTCTGGCTGGT<br>ACTTGCGGGGTCCTGCTGCTTTCACTCGTGATCACTCTTTACTGTAAGCGC<br>GGTCGGAAGAAGCTGCTGTACATCTTTAAGCAACCCTTCATGAGGCCTGTG<br>CAGACTACTAAGAGGAGGACGGCTGTTCATGCCGGTTCCCAGAGGAGGAG<br>GAAGGCGGCTGCGAACTGCGCGTGAAATTCAGCCGCAGCGCAGATGCTCCA<br>GCCTACAAGCAGGGGCAGAACCAGCTCTACAACGAACTCAATCTTGGTCGG<br>AGAGAGGAGTACGACGTGCTGGACAAGCGGAGAGGACGGGACCCAGAAATG<br>GGCGGGAAGCCGCGCAGAAAGAATCCCCAAGAGGGCCTGTACAACGAGCTC<br>CAAAAGGATAAGATGGCAGAAGCCTATAGCGAGATTGGTATGAAAGGGGAA<br>CGCAGAAGAGGCAAAGGCCACGACGGACTGTACCAGGGACTCAGCACCGCC<br>ACCAAGGACACCTATGACGCTCTTCACATGCAGGCCCTGCCGCCTCGG |
| BCMA_EBB-<br>C1978-D4 | | |
| BCMA_EBB-<br>C1978-D4-<br>aa<br>Full CAR | 8596 | MALPVTALLLPLALLLHAARPEVQLLETGGGLVQPGGSLRLSCAASGFSFS<br>SYAMSWVRQAPGKGLEWVSAISGSGGSTYYADSVKGRFTISRDNSKNTLYL<br>QMNSLRAEDTAVYYCAKALVGATGAFDIWGQGTLVTVSSGGGGSGGGGSGG<br>GGSEIVLTQSPGTLSLSPGERATLSCRASQSLSSNFLAWYQQKPGQAPGLL<br>IYGASNWATGTPDRFSGSGSGTDFTLTITRLEPEDFAVYYCQYYGTSPMYT<br>FGQGTKVEIKTTTPAPRPPTPAPTIASQPLSLRPEACRPAAGGAVHTRGLD<br>FACDIYIWAPLAGTCGVLLLSLVITLYCKRGRKKLLYIFKQPFMRPVQTTQ |

TABLE 23-continued

Exemplary BCMA CAR molecules. Sequences are provided with a leader sequence.

| Name/<br>Description | SEQ ID<br>NO: | Sequence |
|---|---|---|
| | | EEDGCSCRFPEEEEGGCELRVKFSRSADAPAYKQGQNQLYNELNLGRREEY<br>DVLDKRRGRDPEMGGKPRRKNPQEGLYNELQKDKMAEAYSEIGMKGERRRG<br>KGHDGLYQGLSTATKDTYDALHMQALPPR |
| BCMA_EBB-<br>C1978-D4-<br>nt<br>Full CAR | 8618 | ATGGCCCTCCCTGTCACCGCCCTGCTGCTTCCGCTGGCTCTTCTGCTCCAC<br>GCCGCTCGGCCCGAAGTGCAGCTGCTCGAAACCGGTGGAGGGCTGGTGCAG<br>CCAGGGGGCTCCCTGAGGCTTTCATGCGCCGCTAGCGGATTCTCCTTCTCC<br>TCTTACGCCATGTCGTGGGTCCGCCAAGCCCCTGGAAAAGGCCTGGAATGG<br>GTGTCCGCGATTTCCGGGAGCGGAGGTTCGACCTATTACGCCGACTCCGTG<br>AAGGGCCGCTTTACCATCTCCCGGGATAACTCCAAGAACACTCTGTACCTC<br>CAAATGAACTCGCTGAGAGCCGAGGACACCGCCGTGTATTACTGCGCGAAG<br>GCGCTGGTCGGCGCGACTGGGGCATTCGACATCTGGGGACAGGGAACTCTT<br>GTGACCGTGTCGAGCGGAGGCGGCGGCTCCGGCGGAGGAGGGAGCGGGGGC<br>GGTGGTTCCGAAATCGTGTTGACTCAGTCCCCGGGAACCCTGAGCTTGTCA<br>CCCGGGGAGCGGGCCACTCTCTCCTGTCGCGCCTCCCAATGCTCTCATCC<br>AATTTCCTGGCCTGGTACCAGCAGAAGCCCGGACAGGCCCCGGGCCTGCTC<br>ATCTACGGCGCTTCAAACTGGGCAACGGGAACCCCTGATCGGTTCAGCGGA<br>AGCGGATCGGGTACTGACTTTACCCTGACCATCACCAGACTGGAACCGGAG<br>GACTTCGCCGTGTACTACTGCCAGTACTACGGCACCTCCCCCATGTACACA<br>TTCGGACAGGGTACCAAGGTCGAGATTAAGACCACTACCCCAGCACCGAGG<br>CCACCCACCCCGGCTCCTACCATCGCCTCCCAGCCTCTGTCCCTGCGTCCG<br>GAGGCATGTAGACCCGCAGCTGGTGGGGCCGTGCATACCCGGGGTCTTGAC<br>TTCGCCTGCGATATCTACATTTGGGCCCCTCTGGCTGGTACTTGCGGGGTC<br>CTGCTGCTTTCACTCGTGATCACTCTTTACTGTAAGCGCGGTCGGAAGAAG<br>CTGCTGTACATCTTTAAGCAACCCTTCATGAGGCCTGTGCAGACTACTCAA<br>GAGGAGGACGGCTGTTCATGCCGGTTCCCAGAGGAGGAGGAAGGCGGCTGC<br>GAACTGCGCGTGAAATTCAGCCGCAGCGCAGATGCTCCAGCCTACAAGCAG<br>GGGCAGAACCAGCTCTACAACGAACTCAATCTTGGTCGGAGAGAGGAGTAC<br>GACGTGCTGGACAAGCGGAGAGGACGGGACCCAGAAATGGGCGGGAAGCCG<br>CGCAGAAAGAATCCCCAAGAGGGCCTGTACAACGAGCTCCAAAAGGATAAG<br>ATGGCAGAAGCCTATAGCGAGATTGGTATGAAAGGGGAACGCAGAAGAGGC<br>AAAGGCCACGACGGACTGTACCAGGGACTCAGCACCGCCACCAAGGACACC<br>TATGACGCTCTTCACATGCAGGCCCTGCCGCCTCGG |
| BCMA_EBB-<br>C1980-A2 | | |
| BCMA_EBB-<br>C1980-A2-<br>aa<br>Full CAR | 8597 | MALPVTALLLPLALLLHAARPEVQLLESGGGLVQPGGSLRLSCAASGFTFS<br>SYAMSWVRQAPGKGLEWVSAISGSGGSTYYADSVKGRFTISRDNSKNTLYL<br>QMNSLRAEDTAVYYCVLWFGEGFDPWGQGTLVTVSSGGGGSGGGGSGGGGS<br>DIVLTQSPLSLPVTPGEPASISCRSSQSLLHSNGYNYLDWYLQKPGQSPQL<br>LIYLGSNRASGVPDRFSGSGSGTDFTLKISRVEAEDVGVYYCMQALQTPLT<br>FGGGTKVDIKTTTPAPRPPTPAPTIASQPLSLRPEACRPAAGGAVHTRGLD<br>FACDIYIWAPLAGTCGVLLLSLVITLYCKRGRKKLLYIFKQPFMRPVQTTQ<br>EEDGCSCRFPEEEEGGCELRVKFSRSADAPAYKQGQNQLYNELNLGRREEY<br>DVLDKRRGRDPEMGGKPRRKNPQEGLYNELQKDKMAEAYSEIGMKGERRRG<br>KGHDGLYQGLSTATKDTYDALHMQALPPR |
| BCMA_EBB-<br>C1980-A2-<br>nt<br>Full CAR | 8619 | ATGGCCCTCCCTGTCACCGCCCTGCTGCTTCCGCTGGCTCTTCTGCTCCAC<br>GCCGCTCGGCCCGAAGTGCAGCTGCTTGAGAGCGGTGGAGGTCTGGTGCAG<br>CCCGGGGGATCACTGCGCCTGTCCTGTGCCGCGTCCGGTTTCACTTTCTCC<br>TCGTACGCCATGTCGTGGGTCAGACAGGCACCGGGAAAGGGACTGGAATGG<br>GTGTCAGCCATTTCGGGTTCGGGGGGCAGCACCTACTACGCTGACTCCGTG<br>AAGGGCCGGTTCACCATTTCCCGCGACAACTCCAAGAACACCTTGTACCTC<br>CAAATGAACTCCCTGCGGGCCGAAGATACCGCCGTGTATTACTGCGTGCTG<br>TGGTTCGGAGAGGGATTCGACCCGTGGGACAAGGAACACTCGTGACTGTG<br>TCATCCGGCGGAGGCGGCAGCGGTGGCGGCGGTTCCGGCGGCGGCGGATCT<br>GACATCGTGTTGACCCAGTCCCCTCTGAGCCTGCCGGTCACTCCTGGCGAA<br>CCAGCCAGCATCTCCTGCCGGTCGAGCCAGTCCCTCCTGCACTCCAATGGG<br>TACAACTACCTCGATTGGTATCTGCAAAAGCCGGGCCAGACCCCCAGCTG<br>CTGATCTACCTTGGGTCAAACCGCGCTTCCGGGGTGCCTGATAGATTCTCC<br>GGGTCCGGGAGCGGAACCGACTTTACCCTGAAAATCTCGAGGGTGGAGGCC<br>GAGGACGTCGGAGTGTACTACTGCATGCAGGCGCTCCAGACTCCCCTGACC<br>TTCGGAGGAGGAACGAAGGTCGACATCAAGACCACTACCCCAGCACCGAGG<br>CCACCCACCCCGGCTCCTACCATCGCCTCCCAGCCTCTGTCCCTGCGTCCG<br>GAGGCATGTAGACCCGCAGCTGGTGGGGCCGTGCATACCCGGGGTCTTGAC<br>TTCGCCTGCGATATCTACATTTGGGCCCCTCTGGCTGGTACTTGCGGGGTC<br>CTGCTGCTTTCACTCGTGATCACTCTTTACTGTAAGCGCGGTCGGAAGAAG<br>CTGCTGTACATCTTTAAGCAACCCTTCATGAGGCCTGTGCAGACTACTCAA<br>GAGGAGGACGGCTGTTCATGCCGGTTCCCAGAGGAGGAGGAAGGCGGCTGC<br>GAACTGCGCGTGAAATTCAGCCGCAGCGCAGATGCTCCAGCCTACAAGCAG<br>GGGCAGAACCAGCTCTACAACGAACTCAATCTTGGTCGGAGAGAGGAGTAC<br>GACGTGCTGGACAAGCGGAGAGGACGGGACCCAGAAATGGGCGGGAAGCCG<br>CGCAGAAAGAATCCCCAAGAGGGCCTGTACAACGAGCTCCAAAAGGATAAG<br>ATGGCAGAAGCCTATAGCGAGATTGGTATGAAAGGGGAACGCAGAAGAGGC<br>AAAGGCCACGACGGACTGTACCAGGGACTCAGCACCGCCACCAAGGACACC<br>TATGACGCTCTTCACATGCAGGCCCTGCCGCCTCGG |

TABLE 23-continued

Exemplary BCMA CAR molecules. Sequences are provided with a leader sequence.

| Name/<br>Description | SEQ ID<br>NO: | Sequence |
|---|---|---|
| BCMA_EBB-<br>C1981-C3 | | |
| BCMA_EBB-<br>C1981-C3-<br>aa<br>Full CAR | 8598 | MALPVTALLLPLALLLHAARPQVQLVESGGGLVQPGGSLRLSCAASGFTFS<br>SYAMSWVRQAPGKGLEWVSAISGSGGSTYYADSVKGRFTISRDNSKNTLYL<br>QMNSLRAEDTAVYYCAKVGYDSSGYYRDYYGMDVWGQGTTVTVSSGGGGSG<br>GGGSGGGGSEIVLTQSPGTLSLSPGERATLSCRASQSVSSSYLAWYQQKPG<br>QAPRLLIYGTSSRATGISDRFSGSGSGTDFTLTISRLEPEDFAVYYCQHYG<br>NSPPKFTFGPGTKLEIKTTTPAPRPPTPAPTIASQPLSLRPEACRPAAGGA<br>VHTRGLDFACDIYIWAPLAGTCGVLLLSLVITLYCKRGRKKLLYIFKQPFM<br>RPVQTTQEEDGCSCRFPEEEEGGCELRVKFSRSADAPAYKQGQNQLYNELN<br>LGRREEYDVLDKRRGRDPEMGGKPRRKNPQEGLYNELQKDKMAEAYSEIGM<br>KGERRRGKGHDGLYQGLSTATKDTYDALHMQALPPR |
| BCMA_EBB-<br>C1981-C3-<br>nt<br>Full CAR | 8620 | ATGGCCCTCCCTGTCACCGCCCTGCTGCTTCCGCTGGCTCTTCTGCTCCAC<br>GCCGCTCGGCCCCAAGTGCAGCTCGTGGAGTCAGGCGGAGGACTGGTGCAG<br>CCCGGGGGCTCCCTGAGACTTTCCTGCGCGGCATCGGGTTTTACCTTCTCC<br>TCCTATGCTATGTCCTGGGTGCGCCAGGCCCCGGGAAAGGGACTGGAATGG<br>GTGTCCGCAATCAGCGGTAGCGGGGGCTCAACATACTACGCCGACTCCGTC<br>AAGGGTCGCTTCACTATTTCCCGGGACAACTCCAAGAATACCCTGTACCTC<br>CAAATGAACAGCCTCAGGGCCGAGGATACTGCCGTGTACTACTGCGCCAAA<br>GTCGGATACGATAGCTCCGGTTACTACCGGGACTACTACGGAATGGACGTG<br>TGGGGACAGGGCACCACCGTGACCGTGTCAAGCGGCGGAGGCGGTTCAGGA<br>GGGGGAGGCTCCGGCGGTGGAGGGTCCGAAATCGTCCTGACTCAGTCGCCT<br>GGCACTCTGTCGTTGTCCCCGGGGGAGCGCGCTACCCTGTCGTGTCGGGCG<br>TCGCAGTCCGTGTCGAGCTCCTACCTCGCGTGGTACCAGCAGAAGCCCGGA<br>CAGGCCCCTAGACTTCTGATCTACGGCACTTCTTCACGCGCCACCGGGATC<br>AGCGACAGGTTCAGCGGCTCCGGCTCCGGGACCGACTTCACCCTGACCATT<br>AGCCGGCTGGAGCCTGAAGATTTCGCCGTGTATTACTGCCAACACTACGGA<br>AACTCGCCGCCAAAGTTCACGTTCGGACCCGGAACCAAGCTGGAAATCAAG<br>ACCACTACCCCAGCACCGAGGCCACCCACCCCGGCTCCTACCATCGCCTCC<br>CAGCCTCTGTCCCTGCGTCCGGAGGCATGTAGACCCGCAGCTGGTGGGGCC<br>GTGCATACCCGGGGTCTTGACTTCGCCTGCGATATCTACATTTGGGCCCCT<br>CTGGCTGGTACTTGCGGGGTCCTGCTGCTTTCACTCGTGATCACTCTTTAC<br>TGTAAGCGCGGTCGGAAGAAGCTGCTGTACATCTTTAAGCAACCCTTCATG<br>AGGCCTGTGCAGACTACTCAAGAGGAGGACGGCTGTTCATGCCGGTTCCCA<br>GAGGAGGAGGAAGGCGGCTGCGAACTGCGCGTGAAATTCAGCCGCAGCGCA<br>GATGCTCCAGCCTACAAGCAGGGCAGAACCAGCTCTACAACGAACTCAAT<br>CTTGGTCGGAGAGAGGAGTACGACGTGCTGGACAAGCGGAGAGGACGGGAC<br>CCAGAAATGGGCGGGAAGCCGCGCAGAAAGAATCCCCAAGAGGGCCTGTAC<br>AACGAGCTCCAAAAGGATAAGATGGCAGAAGCCTATAGCGAGATTGGTATG<br>AAAGGGGAACGCAGAAGAGGCAAAGGCCACGACGGACTGTACCAGGGACTC<br>AGCACCGCCACCAAGGACACCTATGACGCTCTTCACATGCAGGCCCTGCCG<br>CCTCGG |
| BCMA_EBB-<br>C1978-G4 | | |
| BCMA_EBB-<br>C1978-G4-<br>aa<br>Full CAR | 8599 | MALPVTALLLPLALLLHAARPEVQLVESGGGLVQPGGSLRLSCAASGFTFS<br>SYAMSWVRQAPGKGLEWVSAISGSGGSTYYADSVKGRFTISRDNSKNTLYL<br>QMNSLRAEDTAVYYCAKMGWSSGYLGAFDIWGQGTTVTVSSGGGGSGGGGS<br>GGGGSEIVLTQSPGTLSLSPGERATLSCRASQSVASSFLAWYQQKPGQAPR<br>LLIYGASGRATGIPDRFSGSGSGTDFTLTISRLEPEDFAVYYCQHYGGSPR<br>LTFGGGTKVDIKTTTPAPRPPTPAPTIASQPLSLRPEACRPAAGGAVHTRG<br>LDFACDIYIWAPLAGTCGVLLLSLVITLYCKRGRKKLLYIFKQPFMRPVQT<br>TQEEDGCSCRFPEEEEGGCELRVKFSRSADAPAYKQGQNQLYNELNLGRRE<br>EYDVLDKRRGRDPEMGGKPRRKNPQEGLYNELQKDKMAEAYSEIGMKGERR<br>RGKGHDGLYQGLSTATKDTYDALHMQALPPR |
| BCMA_EBB-<br>C1978-G4-<br>nt<br>Full CAR | 8621 | ATGGCCCTCCCTGTCACCGCCCTGCTGCTTCCGCTGGCTCTTCTGCTCCAC<br>GCCGCTCGGCCCGAAGTCCAACTGGTGGAGTCCGGGGGAGGGCTCGTGCAG<br>CCCGGAGGCAGCCTTCGGCTGTCGTGCGCCGCCTCCGGGTTCACGTTCTCA<br>TCCTACGCGATGTCGTGGGTCAGACAGGCACCAGGAAAGGGACTGGAATGG<br>GTGTCCGCCATTAGCGGCTCCGGCGGTAGCACCTACTATGCCGACTCAGTG<br>AAGGGAAGGTTCACTATCTCCCGCGACAACAGCAAGAACACCCTGTACCTC<br>CAAATGAACTCTCTGCGGGCCGAGGATACCGCGGTGTACTATTGCGCCAAG<br>ATGGGTTGGTCAGCGGATACTTGGGAGCCTTCGACATTTGGGGACAGGGC<br>ACTACTGTGACCGTGTCCTCCGGGGGTGGCGGATCGGGAGGCGGCGGCTCG<br>GGTGGAGGGGGTTCCGAAATCGTGTTGACCCAGTCACCGGGAACCCTCTCG<br>CTGTCCCCGGGAGAACGGGCTACACTGTCATGTAGAGCGTCCCAGTCCGTG<br>GCTTCCTCGTTCCTGGCCTGGTACCAGCAGAAGCCGGGACAGGCACCCCGC<br>CTGCTCATCTACGGAGCCAGCGGCCGGGCGACCGGCATCCCTGACCGCTTC<br>TCCGGTTCCGGCTCGGGCACCGACTTTACTCTGACCATTAGCAGGCTTGAG<br>CCCGAGGATTTTGCCGTGTACTACTGCCAACACTACGGGGGAGCCCTCGC<br>CTGACCTTCGGAGGCGGAACTAAGGTCGATATCAAAACCACTACCCCAGCA<br>CCGAGGCCACCCACCCCGGCTCCTACCATCGCCTCCCAGCCTCTGTCCCTG |

TABLE 23-continued

Exemplary BCMA CAR molecules. Sequences are provided with a leader sequence.

| Name/<br>Description | SEQ ID<br>NO: | Sequence |
|---|---|---|
| | | CGTCCGGAGGCATGTAGACCCGCAGCTGGTGGGGCCGTGCATACCCGGGGT<br>CTTGACTTCGCCTGCGATATCTACATTTGGGCCCCTCTGGCTGGTACTTGC<br>GGGGTCCTGCTGCTTTCACTCGTGATCACTCTTTACTGTAAGCGCGGTCGG<br>AAGAAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAAGGC<br>GGCTGCGAACTGCGCGTGAAATTCAGCCGCAGCGCAGATGCTCCAGCCTAC<br>AAGCAGGGGCAGAACCAGCTCTACAACGAACTCAATCTTGGTCGGAGAGAG<br>GAGTACGACGTGCTGGACAAGCGGAGAGGACGGGACCCAGAAATGGGCGGG<br>AAGCCGCGCAGAAAGAATCCCCAAGAGGGCCTGTACAACGAGCTCCAAAAG<br>GATAAGATGGCAGAAGCCTATAGCGAGATTGGTATGAAAGGGGAACGCAGA<br>AGAGGCAAAGGCCACGACGGACTGTACCAGGGACTCAGCACCGCCACCAAG<br>GACACCTATGACGCTCTTCACATGCAGGCCCTGCCGCCTCGG |

In one embodiment, the CAR molecule comprises (e.g., consists of) an amino acid sequence provided in Table 23, or Table 1 of WO2016/014565, or as otherwise described herein. In one embodiment, the CAR molecule comprises (e.g., consists of) an amino acid sequence of SEQ ID NO: 8549, SEQ ID NO: 8550, SEQ ID NO: 8551, SEQ ID NO: 8552, SEQ ID NO: 8553, SEQ ID NO: 8554, SEQ ID NO: 8555, SEQ ID NO: 8556, SEQ ID NO: 8557, SEQ ID NO: 8558, SEQ ID NO: 8559, SEQ ID NO: 8560, SEQ ID NO: 8561, SEQ ID NO: 8562, SEQ ID NO: 8563, SEQ ID NO: 8579, SEQ ID NO: 8580, SEQ ID NO: 8581, SEQ ID NO: 8582, SEQ ID NO: 8583, SEQ ID NO: 8584, SEQ ID NO: 8585, SEQ ID NO: 8586, SEQ ID NO: 8587, SEQ ID NO: 8588, SEQ ID NO: 8589, SEQ ID NO: 8590, SEQ ID NO: 8591, SEQ ID NO: 8592, SEQ ID NO: 8593, SEQ ID NO: 8594, SEQ ID NO: 8595, SEQ ID NO: 8596, SEQ ID NO: 8597, SEQ ID NO: 8598, or SEQ ID NO: 8599; or an amino acid sequence having at least one, two, three, four, five, 10, 15, 20 or 30 modifications (e.g., substitutions, e.g., conservative substitutions) but not more than 60, 50, or 40 modifications (e.g., substitutions, e.g., conservative substitutions) of an amino acid sequence of SEQ ID NO: 8549, SEQ ID NO: 8550, SEQ ID NO: 8551, SEQ ID NO: 8552, SEQ ID NO: 8553, SEQ ID NO: 8554, SEQ ID NO: 8555, SEQ ID NO: 8556, SEQ ID NO: 8557, SEQ ID NO: 8558, SEQ ID NO: 8559, SEQ ID NO: 8560, SEQ ID NO: 8561, SEQ ID NO: 8562, SEQ ID NO: 8563, SEQ ID NO: 8579, SEQ ID NO: 8580, SEQ ID NO: 8581, SEQ ID NO: 8582, SEQ ID NO: 8583, SEQ ID NO: 8584, SEQ ID NO: 8585, SEQ ID NO: 8586, SEQ ID NO: 8587, SEQ ID NO: 8588, SEQ ID NO: 8589, SEQ ID NO: 8590, SEQ ID NO: 8591, SEQ ID NO: 8592, SEQ ID NO: 8593, SEQ ID NO: 8594, SEQ ID NO: 8595, SEQ ID NO: 8596, SEQ ID NO: 8597, SEQ ID NO: 8598, or SEQ ID NO: 8599; or an amino acid sequence having 85%, 90%, 95%, 96%, 97%, 98%, 99% identity to an amino acid sequence of SEQ ID NO: 8549, SEQ ID NO: 8550, SEQ ID NO: 8551, SEQ ID NO: 8552, SEQ ID NO: 8553, SEQ ID NO: 8554, SEQ ID NO: 8555, SEQ ID NO: 8556, SEQ ID NO: 8557, SEQ ID NO: 8558, SEQ ID NO: 8559, SEQ ID NO: 8560, SEQ ID NO: 8561, SEQ ID NO: 8562, SEQ ID NO: 8563, SEQ ID NO: 8579, SEQ ID NO: 8580, SEQ ID NO: 8581, SEQ ID NO: 8582, SEQ ID NO: 8583, SEQ ID NO: 8584, SEQ ID NO: 8585, SEQ ID NO: 8586, SEQ ID NO: 8587, SEQ ID NO: 8588, SEQ ID NO: 8589, SEQ ID NO: 8590, SEQ ID NO: 8591, SEQ ID NO: 8592, SEQ ID NO: 8593, SEQ ID NO: 8594, SEQ ID NO: 8595, SEQ ID NO: 8596, SEQ ID NO: 8597, SEQ ID NO: 8598, or SEQ ID NO: 8599.

Transmembrane Domains

With respect to the transmembrane domain, in various embodiments, a CAR can be designed to comprise a transmembrane domain that is attached to the extracellular domain of the CAR. A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is one that is associated with one of the other domains of the CAR e.g., in one embodiment, the transmembrane domain may be from the same protein that the signaling domain, costimulatory domain or the hinge domain is derived from. In another aspect, the transmembrane domain is not derived from the same protein that any other domain of the CAR is derived from. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another CAR on the cell surface of a CAR-expressing cell. In a different aspect, the amino acid sequence of the transmembrane domain may be modified or substituted so as to minimize interactions with the binding domains of the native binding partner present in the same CAR-expressing cell.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the CAR has bound to a target. A transmembrane domain of particular use in this invention may include at least the transmembrane region(s) of e.g., the alpha, beta or zeta chain of the T-cell receptor, CD28, CD27, CD3 epsilon, CD45, CD4, CD5, CD8, CD9, CD16, CD22, CD33, CD37, CD64, CD80, CD86, CD134, CD137, CD154. In some embodiments, a transmembrane domain may include at least the transmembrane region(s) of, e.g., KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), NKp44, NKp30, NKp46, CD160, CD19, IL2R beta, IL2R gamma, IL7Rα, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKG2D, NKG2C.

In some instances, the transmembrane domain can be attached to the extracellular region of the CAR, e.g., the antigen binding domain of the CAR, via a hinge, e.g., a hinge from a human protein. For example, in one embodiment, the hinge can be a human Ig (immunoglobulin) hinge (e.g., an IgG4 hinge, an IgD hinge), a GS linker (e.g., a GS linker described herein), a KIR2DS2 hinge or a CD8a hinge. In one embodiment, the hinge or spacer comprises (e.g., consists of) the amino acid sequence of SEQ ID NO:6642. In one aspect, the transmembrane domain comprises (e.g., consists of) a transmembrane domain of SEQ ID NO: 6644.

In certain embodiments, the encoded transmembrane domain comprises an amino acid sequence of a CD8 transmembrane domain having at least one, two or three modifications but not more than 20, 10 or 5 modifications of an amino acid sequence of SEQ ID NO: 6644, or a sequence with 95-99% identity to an amino acid sequence of SEQ ID NO: 6644. In one embodiment, the encoded transmembrane domain comprises the sequence of SEQ ID NO: 6644.

In other embodiments, the nucleic acid molecule encoding the CAR comprises a nucleotide sequence of a CD8 transmembrane domain, e.g., comprising the sequence of SEQ ID NO: 6645, or a sequence with 95-99% identity thereof.

In certain embodiments, the encoded antigen binding domain is connected to the transmembrane domain by a hinge region. In one embodiment, the encoded hinge region comprises the amino acid sequence of a CD8 hinge, e.g., SEQ ID NO: 6642; or the amino acid sequence of an IgG4 hinge, e.g., SEQ ID NO: 6630, or a sequence with 95-99% identity to SEQ ID NO: 6642 or 6630. In other embodiments, the nucleic acid sequence encoding the hinge region comprises a sequence of SEQ ID NO: 6643 or SEQ ID NO: 6631, corresponding to a CD8 hinge or an IgG4 hinge, respectively, or a sequence with 95-99% identity to SEQ ID NO:6643 or 6631.

In one aspect, the hinge or spacer comprises an IgG4 hinge. For example, in one embodiment, the hinge or spacer comprises a hinge of the amino acid sequence ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQ VYTLPPSQEEMTKNQVSLTCLVKGFYP SDIAVEWESNGQPENNYKTTPPVLDSDGSFFLYSRLTVDKSRWQEGNVFSCSVMHEALHNHYTQKSLSLSLGKM (SEQ ID NO:6630). In some embodiments, the hinge or spacer comprises a hinge encoded by a nucleotide sequence of

```
                                         (SEQ ID NO: 6631)
GAGAGCAAGTACGGCCCTCCCTGCCCCCCTTGCCCTGCCCCCGAGTTCCT

GGGCGGACCCAGCGTGTTCCTGTTCCCCCCCAAGCCCAAGGACACCCTGA

TGATCAGCCGGACCCCCGAGGTGACCTGTGTGGTGGTGGACGTGTCCCAG
```

```
-continued
GAGGACCCCGAGGTCCAGTTCAACTGGTACGTGGACGGCGTGGAGGTGCA

CAACGCCAAGACCAAGCCCCGGGAGGAGCAGTTCAATAGCACCTACCGGG

TGGTGTCCGTGCTGACCGTGCTGCACCAGGACTGGCTGAACGGCAAGGAA

TACAAGTGTAAGGTGTCCAACAAGGGCCTGCCCAGCAGCATCGAGAAAAC

CATCAGCAAGGCCAAGGGCCAGCCTCGGGAGCCCCAGGTGTACACCCTGC

CCCCTAGCCAAGAGGAGATGACCAAGAACCAGGTGTCCCTGACCTGCCTG

GTGAAGGGCTTCTACCCCAGCGACATCGCCGTGGAGTGGGAGAGCAACGG

CCAGCCCGAGAACAACTACAAGACCACCCCCCCTGTGCTGGACAGCGACG

GCAGCTTCTTCCTGTACAGCCGGCTGACCGTGGACAAGAGCCGGTGGCAG

GAGGGCAACGTCTTTAGCTGCTCCGTGATGCACGAGGCCCTGCACAACCA

CTACACCCAGAAGAGCCTGAGCCTGTCCCTGGGCAAGATG.
```

In one aspect, the hinge or spacer comprises an IgD hinge. For example, in one embodiment, the hinge or spacer comprises a hinge of the amino acid sequence RWPESPKAQASSVPTAQPQAEGSLAKATTAPATTRNTGRGGEEKKKEKEKEEQEERETKTPECP SHTQPLGVYLLTPAVQDLWLRDKATFTCFVVGSDLKDAHLTWEVAGKVPTGGVEEGLLERHSN GSQSQHSRLTLPRSLWNAGTSVTCTLNHPSLPPQRLMALREPAAQAPVKLSLNLLASSDPPEAAS WLLCEVSGFSPPNILLMWLEDQREVNTSGFAPARPPPQPGSTTFWAWSVLRVPAPPSPQPATYTC VVSHEDSRTLLNASRSLEVSYVTDH (SEQ ID NO:6632). In some embodiments, the hinge or spacer comprises a hinge encoded by a nucleotide sequence of

```
                                         (SEQ ID NO: 6633)
AGGTGGCCCGAAAGTCCCAAGGCCCAGGCATCTAGTGTTCCTACTGCACA

GCCCCAGGCAGAAGGCAGCCTAGCCAAAGCTACTACTGCACCTGCCACTA

CGCGCAATACTGGCCGTGGCGGGGAGGAGAAGAAAAAGGAGAAAGAGAAA

GAAGAACAGGAAGAGAGGGGAGACCAAGACCCCTGAATGTCCATCCCATAC

CCAGCCGCTGGGCGTCTATCTCTTGACTCCCGCAGTACAGGACTTGTGGC

TTAGAGATAAGGCCACCTTTACATGTTTCGTCGTGGGCTCTGACCTGAAG

GATGCCCATTTGACTTGGGAGGTTGCCGGAAAGGTACCCACAGGGGGGT

TGAGGAAGGGTTGCTGGAGCGCCATTCCAATGGCTCTCAGAGCCAGCACT

CAAGACTCACCCTTCCGAGATCCCTGTGGAACGCCGGGACCTCTGTCACA

TGTACTCTAAATCATCCTAGCCTGCCCCCACAGCGTCTGATGGCCCTTAG

AGAGCCAGCCGCCCAGGCACCAGTTAAGCTTAGCCTGAATCTGCTCGCCA

GTAGTGATCCCCCAGAGGCCGCCAGCTGGCTCTTATGCGAAGTGTCCGGC

TTTAGCCCGCCCAACATCTTGCTCATGTGGCTGGAGGACCAGCGAGAAGT

GAACACCAGCGGCTTCGCTCCAGCCCGGCCCCCACCCCAGCCGGGTTCTA

CCACATTCTGGGCCTGGAGTGTCTTAAGGGTCCCAGCACCACCTAGCCCC

CAGCCAGCCACATACACCTGTGTTGTGTCCCATGAAGATAGCAGGACCCT

GCTAAATGCTTCTAGGAGTCTGGAGGTTTCCTACGTGACTGACCATT.
```

In one aspect, the transmembrane domain may be recombinant, in which case it will comprise predominantly hydrophobic residues such as leucine and valine. In one aspect a triplet of phenylalanine, tryptophan and valine can be found at each end of a recombinant transmembrane domain.

Optionally, a short oligo- or polypeptide linker, between 2 and 10 amino acids in length may form the linkage between the transmembrane domain and the cytoplasmic region of the CAR. A glycine-serine doublet provides a particularly suitable linker. For example, in one aspect, the linker comprises the amino acid sequence of GGGGSGGGGS (SEQ ID NO:6634). In some embodiments, the linker is encoded by a nucleotide sequence of GGTGGCGGAGGTTCTGGAGGTGGAGGTTCC (SEQ ID NO:6635).

In one aspect, the hinge or spacer comprises a KIR2DS2 hinge.

Signaling Domains

In embodiments of the invention having an intracellular signaling domain, such a domain can contain, e.g., one or more of a primary signaling domain and/or a costimulatory signaling domain. In some embodiments, the intracellular signaling domain comprises a sequence encoding a primary signaling domain. In some embodiments, the intracellular signaling domain comprises a costimulatory signaling domain. In some embodiments, the intracellular signaling domain comprises a primary signaling domain and a costimulatory signaling domain.

The intracellular signaling sequences within the cytoplasmic portion of the CAR of the invention may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequences. In one embodiment, a glycine-serine doublet can be used as a suitable linker. In one embodiment, a single amino acid, e.g., an alanine, a glycine, can be used as a suitable linker.

In one aspect, the intracellular signaling domain is designed to comprise two or more, e.g., 2, 3, 4, 5, or more, costimulatory signaling domains. In an embodiment, the two or more, e.g., 2, 3, 4, 5, or more, costimulatory signaling domains, are separated by a linker molecule, e.g., a linker molecule described herein. In one embodiment, the intracellular signaling domain comprises two costimulatory signaling domains. In some embodiments, the linker molecule is a glycine residue. In some embodiments, the linker is an alanine residue.

Primary Signaling Domains

A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs or ITAMs.

Examples of ITAM containing primary intracellular signaling domains that are of particular use in the invention include those of CD3 zeta, common FcR gamma (FCER1G), Fc gamma RIIa, FcR beta (Fc Epsilon R1b), CD3 gamma, CD3 delta, CD3 epsilon, CD79a, CD79b, DAP10, and DAP12. In one embodiment, a CAR of the invention comprises an intracellular signaling domain, e.g., a primary signaling domain of CD3-zeta.

In one embodiment, the encoded primary signaling domain comprises a functional signaling domain of CD3 zeta. The encoded CD3 zeta primary signaling domain can comprise an amino acid sequence having at least one, two or three modifications but not more than 20, 10 or 5 modifications of an amino acid sequence of SEQ ID NO: 6648 or SEQ ID NO: 6650, or a sequence with 95-99% identity to an amino acid sequence of SEQ ID NO: 6648 or SEQ ID NO: 6650. In some embodiments, the encoded primary signaling domain comprises a sequence of SEQ ID NO: 6648 or SEQ ID NO: 6650. In other embodiments, the nucleic acid sequence encoding the primary signaling domain comprises a sequence of SEQ ID NO: 6649 or SEQ ID NO: 6651, or a sequence with 95-99% identity thereof.

Costimulatory Signaling Domains

In some embodiments, the encoded intracellular signaling domain comprises a costimulatory signaling domain. For example, the intracellular signaling domain can comprise a primary signaling domain and a costimulatory signaling domain. In some embodiments, the encoded costimulatory signaling domain comprises a functional signaling domain of a protein chosen from one or more of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CDS, ICAM-1, GITR, BAFFR, HVEM (LIGHTR), SLAMF7, NKp80 (KLRF1), CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKp44, NKp30, NKp46, or NKG2D.

In certain embodiments, the encoded costimulatory signaling domain comprises an amino acid sequence having at least one, two or three modifications but not more than 20, 10 or 5 modifications of an amino acid sequence of SEQ ID NO: 6646 or SEQ ID NO: 6636, or a sequence with 95-99% identity to an amino acid sequence of SEQ ID NO: 6646 or SEQ ID NO: 6636. In one embodiment, the encoded costimulatory signaling domain comprises a sequence of SEQ ID NO: 6646 or SEQ ID NO: 6636. In other embodiments, the nucleic acid sequence encoding the costimulatory signaling domain comprises a sequence of SEQ ID NO: 6647 or SEQ ID NO: 6637, or a sequence with 95-99% identity thereof.

In other embodiments, the encoded intracellular domain comprises the sequence of SEQ ID NO: 6646 or SEQ ID NO: 6636, and the sequence of SEQ ID NO: 6648 or SEQ ID NO: 6650, wherein the sequences comprising the intracellular signaling domain are expressed in the same frame and as a single polypeptide chain.

In certain embodiments, the nucleic acid sequence encoding the intracellular signaling domain comprises a sequence of SEQ ID NO: 6647 or SEQ ID NO: 6637, or a sequence with 95-99% identity thereof, and a sequence of SEQ ID NO: 6649 or SEQ ID NO: 6651, or a sequence with 95-99% identity thereof.

In some embodiments, the nucleic acid molecule further encodes a leader sequence. In one embodiment, the leader sequence comprises the sequence of SEQ ID NO: 6640.

In one aspect, the intracellular signaling domain is designed to comprise the signaling domain of CD3-zeta and the signaling domain of CD28. In one aspect, the intracellular signaling domain is designed to comprise the signaling domain of CD3-zeta and the signaling domain of 4-1BB. In one aspect, the signaling domain of 4-1BB is a signaling domain of SEQ ID NO: 6646. In one aspect, the signaling domain of CD3-zeta is a signaling domain of SEQ ID NO: 6648.

In one aspect, the intracellular signaling domain is designed to comprise the signaling domain of CD3-zeta and the signaling domain of CD27. In one aspect, the signaling domain of CD27 comprises an amino acid sequence of QRRKYRSNKGESPVEPAEPCRYSCPREEEGSTIP-IQEDYRKPEPACSP (SEQ ID NO: 6636). In one aspect, the signalling domain of CD27 is encoded by a nucleic acid sequence of (SEQ ID NO: 6637)
AGGAGTAAGAGGAGCAGGCTCCTGCACAGTGACTACATGAACATGACTCC

CCGCCGCCCCGGGCCCACCCGCAAGCATTACCAGCCCTATGCCCCACCAC

GCGACTTCGCAGCCTATCGCTCC.

Vectors

In another aspect, the invention pertains to a vector comprising a nucleic acid sequence encoding a CAR described herein. In one embodiment, the vector is chosen from a DNA vector, an RNA vector, a plasmid, a lentivirus vector, adenoviral vector, or a retrovirus vector. In one embodiment, the vector is a lentivirus vector. These vectors or portions thereof may, among other things, be used to create template nucleic acids, as described herein for use with the CRISPR systems as described herein. Alternatively, the vectors may be used to deliver nucleic acid directly to the cell, e.g., the immune effector cell, e.g., the T cell, e.g., the allogeneic T cell, independent of the CRISPR system.

The present invention also provides vectors in which a DNA of the present invention is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity. A retroviral vector may also be, e.g., a gammaretroviral vector. A gammaretroviral vector may include, e.g., a promoter, a packaging signal (ψ), a primer binding site (PBS), one or more (e.g., two) long terminal repeats (LTR), and a transgene of interest, e.g., a gene encoding a CAR. A gammaretroviral vector may lack viral structural gens such as gag, pol, and env. Exemplary gammaretroviral vectors include Murine Leukemia Virus (MLV), Spleen-Focus Forming Virus (SFFV), and Myeloproliferative Sarcoma Virus (MPSV), and vectors derived therefrom. Other gammaretroviral vectors are described, e.g., in Tobias Maetzig et al., "Gammaretroviral Vectors: Biology, Technology and Application" Viruses. 2011 June; 3(6): 677-713.

In another embodiment, the vector comprising the nucleic acid encoding the desired CAR of the invention is an adenoviral vector (A5/35). In another embodiment, the expression of nucleic acids encoding CARs can be accomplished using of transposons such as sleeping beauty, crisper, CAS9, and zinc finger nucleases. See below June et al. 2009 *Nature Reviews Immunology* 9.10: 704-716, is incorporated herein by reference.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Disclosed herein are methods for producing an in vitro transcribed RNA CAR. The present invention also includes a CAR encoding RNA construct that can be directly transfected into a cell. A method for generating mRNA for use in transfection can involve in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (SEQ ID NO: 6638). RNA so produced can efficiently transfect different kinds of cells. In one aspect, the template includes sequences for the CAR.

Non-Viral Delivery Methods

In some aspects, non-viral methods can be used to deliver a nucleic acid encoding a CAR described herein into a cell or tissue or a subject.

In some embodiments, the non-viral method includes the use of a transposon (also called a transposable element). In some embodiments, a transposon is a piece of DNA that can insert itself at a location in a genome, for example, a piece of DNA that is capable of self-replicating and inserting its copy into a genome, or a piece of DNA that can be spliced out of a longer nucleic acid and inserted into another place in a genome. For example, a transposon comprises a DNA sequence made up of inverted repeats flanking genes for transposition.

In some embodiments, cells, e.g., T or NK cells, are generated that express a CAR described herein by using a combination of gene insertion using the SBTS and genetic editing using a nuclease (e.g., Zinc finger nucleases (ZFNs), Transcription Activator-Like Effector Nucleases (TALENs), the CRISPR/Cas system, or engineered meganuclease re-engineered homing endonucleases).

In some embodiments, cells of the invention, e.g., T or NK cells, e.g., allogeneic T cells, e.g., described herein, (e.g., that express a CAR described herein) are generated by contacting the cells with (a) a composition comprising one or more gRNA molecules, e.g., as described herein, and one or more Cas molecules, e.g., a Cas9 molecule, e.g., as described herein, and (b) nucleic acid comprising sequence encoding a CAR, e.g., described herein (such as a template nucleic acid molecule as described herein).

Without being bound by theory, said composition of (a), above, will induce a break at or near the genomic DNA targeted by the targeting domain of the gRNA molecule(s), and the nucleic acid of (b) will incorporate, e.g., partially or wholly, into the genome at or near said break, such that upon integration, the encoded CAR molecule is expressed. In embodiments, expression of the CAR will be controlled by promoters or other regulatory elements endogenous to the genome (e.g., the promoter controlling expression from the gene in which the nucleic acid of (b) was inserted). In other embodiments, the nucleic acid of (b) further comprises a promoter and/or other regulatory elements, e.g., as described herein, e.g., an EF1-alpha promoter, operably linked to the sequence encoding the CAR, such that upon integration, expression of the CAR is controlled by that promoter and/or other regulatory elements. Additional features of the invention relating to use of CRISPR/Cas9 systems, e.g., as described herein, to direct incorporation of nucleic acid sequence encoding a CAR, e.g., as described herein, are described elsewhere in this application, e.g., in the section relating to gene insertion and homologous recombination. In embodiments, the composition of a) above is a composition comprising RNPs comprising the one or more gRNA molecules. In embodiments, RNPs comprising gRNAs targeting unique target sequences are introduced into the cell simultaneously, e.g., as a mixture of RNPs comprising the one or more gRNAs. In embodiments, RNPs comprising gRNAs targeting unique target sequences are introduced into the cell sequentially.

In some embodiments, use of a non-viral method of delivery permits reprogramming of cells, e.g., T or NK cells, and direct infusion of the cells into a subject. Advantages of non-viral vectors include but are not limited to the ease and relatively low cost of producing sufficient amounts required to meet a patient population, stability during storage, and lack of immunogenicity.

Inhibitory Domains

In an embodiment, the vector comprises a nucleic acid sequence that encodes a CAR, e.g., a CAR described herein, and a nucleic acid sequence that encodes an inhibitory molecule comprising: an inhKIR cytoplasmic domain; a transmembrane domain, e.g., a KIR transmembrane domain; and an inhibitor cytoplasmic domain, e.g., an ITIM domain, e.g., an inhKIR ITIM domain. In an embodiment the inhibitory molecule is a naturally occurring inhKIR, or a sequence sharing at least 50, 60, 70, 80, 85, 90, or 99% homology with, or that differs by no more than 1, 2, 3, 4, 5, 6, 7, 8, 9, 10, 15, or 20 residues from, a naturally occurring inhKIR.

In an embodiment, the nucleic acid sequence that encodes an inhibitory molecule comprises: a SLAM family cytoplasmic domain; a transmembrane domain, e.g., a SLAM family transmembrane domain; and an inhibitor cytoplasmic domain, e.g., a SLAM family domain, e.g., an SLAM family ITIM domain. In an embodiment the inhibitory molecule is a naturally occurring SLAM family member, or a sequence sharing at least 50, 60, 70, 80, 85, 90, 95, or 99% homology with, or that differs by no more than 1, 2, 3, 4, 5, 6, 7, 8, 9, 10, 15, or 20 residues from, a naturally occurring SLAM family member.

In one embodiment, the vector is an in vitro transcribed vector, e.g., a vector that transcribes RNA of a nucleic acid molecule described herein. In one embodiment, the nucleic acid sequence in the vector further comprises a poly(A) tail, e.g., a poly A tail. In one embodiment, the nucleic acid sequence in the vector further comprises a 3'UTR, e.g., a 3' UTR described herein, e.g., comprising at least one repeat of a 3'UTR derived from human beta-globulin. In one embodiment, the nucleic acid sequence in the vector further comprises promoter, e.g., a T2A promoter.

Promoters

In one embodiment, the vector further comprises a promoter. In some embodiments, the promoter is chosen from an EF-1 promoter, a CMV IE gene promoter, an EF-1α promoter, an ubiquitin C promoter, or a phosphoglycerate kinase (PGK) promoter. In one embodiment, the promoter is an EF-1 promoter. In one embodiment, the EF-1 promoter comprises a sequence of SEQ ID NO: 6639.

Host Cells for CAR Expression

As noted above, in some aspects the invention pertains to a cell, e.g., an immune effector cell, (e.g., a population of cells, e.g., a population of immune effector cells) comprising a nucleic acid molecule, a CAR polypeptide molecule, or a vector as described herein.

In certain aspects of the present disclosure, immune effector cells, e.g., T cells, can be obtained from a unit of blood collected from a subject using any number of techniques known to the skilled artisan, such as Ficoll™ separation. In one preferred aspect, cells from the circulating blood of an individual are obtained by apheresis. The apheresis product typically contains lymphocytes, including T cells, monocytes, granulocytes, B cells, other nucleated white blood cells, red blood cells, and platelets. In one aspect, the cells collected by apheresis may be washed to remove the plasma fraction and, optionally, to place the cells in an appropriate buffer or media for subsequent processing steps. In one embodiment, the cells are washed with phosphate buffered saline (PBS). In an alternative embodiment, the wash solution lacks calcium and may lack magnesium or may lack many if not all divalent cations.

Initial activation steps in the absence of calcium can lead to magnified activation. As those of ordinary skill in the art would readily appreciate a washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer.

Alternatively, the undesirable components of the apheresis sample may be removed and the cells directly resuspended in culture media.

It is recognized that the methods of the application can utilize culture media conditions comprising 5% or less, for example 2%, human AB serum, and employ known culture media conditions and compositions, for example those described in Smith et al., "Ex vivo expansion of human T cells for adoptive immunotherapy using the novel Xeno-free CTS Immune Cell Serum Replacement" *Clinical & Translational Immunology* (2015) 4, e31; doi:10.1038/cti.2014.31.

In one aspect, T cells are isolated from peripheral blood lymphocytes by lysing the red blood cells and depleting the monocytes, for example, by centrifugation through a PERCOLL™ gradient or by counterflow centrifugal elutriation.

The methods described herein can include, e.g., selection of a specific subpopulation of immune effector cells, e.g., T cells, that are a T regulatory cell-depleted population, CD25+ depleted cells, using, e.g., a negative selection technique, e.g., described herein. Preferably, the population of T regulatory depleted cells contains less than 30%, 25%, 20%, 15%, 10%, 5%, 4%, 3%, 2%, 1% of CD25+ cells.

In one embodiment, T regulatory cells, e.g., CD25+ T cells, are removed from the population using an anti-CD25 antibody, or fragment thereof, or a CD25-binding ligand, IL-2. In one embodiment, the anti-CD25 antibody, or fragment thereof, or CD25-binding ligand is conjugated to a substrate, e.g., a bead, or is otherwise coated on a substrate, e.g., a bead. In one embodiment, the anti-CD25 antibody, or fragment thereof, is conjugated to a substrate as described herein.

In one embodiment, the T regulatory cells, e.g., CD25+ T cells, are removed from the population using CD25 depletion reagent from Miltenyi™. In one embodiment, the ratio of cells to CD25 depletion reagent is 1e7 cells to 20 uL, or 1e7 cells to 15 uL, or 1e7 cells to 10 uL, or 1e7 cells to 5 uL, or 1e7 cells to 2.5 uL, or 1e7 cells to 1.25 uL. In one embodiment, e.g., for T regulatory cells, e.g., CD25+ depletion, greater than 500 million cells/ml is used. In a further aspect, a concentration of cells of 600, 700, 800, or 900 million cells/ml is used.

In one embodiment, the population of immune effector cells to be depleted includes about $6 \times 10^9$ CD25+ T cells. In other aspects, the population of immune effector cells to be depleted include about $1 \times 10^9$ to $1 \times 10^{10}$ CD25+ T cell, and any integer value in between. In one embodiment, the resulting population T regulatory depleted cells has $2 \times 10^9$ T regulatory cells, e.g., CD25+ cells, or less (e.g., $1 \times 10^9$, $5 \times 10^8$, $1 \times 10^8$, $5 \times 10^7$, $1 \times 10^7$, or less CD25+ cells).

In one embodiment, the T regulatory cells, e.g., CD25+ cells, are removed from the population using the CliniMAC system with a depletion tubing set, such as, e.g., tubing 162-01. In one embodiment, the CliniMAC system is run on a depletion setting such as, e.g., DEPLETION2.1.

Without wishing to be bound by a particular theory, decreasing the level of negative regulators of immune cells (e.g., decreasing the number of unwanted immune cells, e.g., $T_{REG}$ cells), in a subject prior to apheresis or during manufacturing of a CAR-expressing cell product can reduce the risk of subject relapse. For example, methods of depleting $T_{REG}$ cells are known in the art. Methods of decreasing $T_{REG}$ cells include, but are not limited to, cyclophosphamide, anti-GITR antibody (an anti-GITR antibody described herein), CD25-depletion, and combinations thereof.

In some embodiments, the manufacturing methods comprise reducing the number of (e.g., depleting) $T_{REG}$ cells prior to manufacturing of the CAR-expressing cell. For example, manufacturing methods comprise contacting the sample, e.g., the apheresis sample, with an anti-GITR antibody and/or an anti-CD25 antibody (or fragment thereof, or a CD25-binding ligand), e.g., to deplete $T_{REG}$ cells prior to manufacturing of the CAR-expressing cell (e.g., T cell, NK cell) product.

In an embodiment, a subject is pre-treated with one or more therapies that reduce $T_{REG}$ cells prior to collection of cells for CAR-expressing cell product manufacturing, thereby reducing the risk of subject relapse to CAR-expressing cell treatment. In an embodiment, methods of decreasing $T_{REG}$ cells include, but are not limited to, administration to the subject of one or more of cyclophosphamide, anti-GITR antibody, CD25-depletion, or a combination thereof. Administration of one or more of cyclophosphamide, anti-GITR antibody, CD25-depletion, or a combination thereof, can occur before, during or after an infusion of the CAR-expressing cell product.

In an embodiment, a subject is pre-treated with cyclophosphamide prior to collection of cells for CAR-expressing cell product manufacturing, thereby reducing the risk of subject relapse to CAR-expressing cell treatment. In an embodiment, a subject is pre-treated with an anti-GITR antibody prior to collection of cells for CAR-expressing cell product manufacturing, thereby reducing the risk of subject relapse to CAR-expressing cell treatment.

In one embodiment, the population of cells to be removed are neither the regulatory T cells or tumor cells, but cells that otherwise negatively affect the expansion and/or function of CART cells, e.g. cells expressing CD14, CD11b, CD33, CD15, or other markers expressed by potentially immune suppressive cells. In one embodiment, such cells are envisioned to be removed concurrently with regulatory T cells and/or tumor cells, or following said depletion, or in another order.

The methods described herein can include more than one selection step, e.g., more than one depletion step. Enrichment of a T cell population by negative selection can be accomplished, e.g., with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail can include antibodies to CD14, CD20, CD11b, CD16, HLA-DR, and CD8.

The methods described herein can further include removing cells from the population which express a tumor antigen, e.g., a tumor antigen that does not comprise CD25, e.g., CD19, CD30, CD38, CD123, CD20, CD14 or CD11b, to thereby provide a population of T regulatory depleted, e.g., CD25+ depleted, and tumor antigen depleted cells that are suitable for expression of a CAR, e.g., a CAR described herein. In one embodiment, tumor antigen expressing cells are removed simultaneously with the T regulatory, e.g., CD25+ cells. For example, an anti-CD25 antibody, or fragment thereof, and an anti-tumor antigen antibody, or fragment thereof, can be attached to the same substrate, e.g., bead, which can be used to remove the cells or an anti-CD25 antibody, or fragment thereof, or the anti-tumor antigen antibody, or fragment thereof, can be attached to separate beads, a mixture of which can be used to remove the cells. In other embodiments, the removal of T regulatory cells, e.g., CD25+ cells, and the removal of the tumor antigen expressing cells is sequential, and can occur, e.g., in either order.

Also provided are methods that include removing cells from the population which express a check point inhibitor, e.g., a check point inhibitor described herein, e.g., one or more of PD1+ cells, LAG3+ cells, and TIM3+ cells, to thereby provide a population of T regulatory depleted, e.g., CD25+ depleted cells, and check point inhibitor depleted cells, e.g., PD1+, LAG3+ and/or TIM3+ depleted cells. Exemplary check point inhibitors include B7-H1, B7-1, CD160, P1H, 2B4, PD1, TIM3, CEACAM (e.g., CEACAM-1, CEACAM-3 and/or CEACAM-5), LAG3, TIGIT, CTLA-4, BTLA and LAIR1. In one embodiment, check point inhibitor expressing cells are removed simultaneously with the T regulatory, e.g., CD25+ cells. For example, an anti-CD25 antibody, or fragment thereof, and an anti-check point inhibitor antibody, or fragment thereof, can be attached to the same bead which can be used to remove the cells, or an anti-CD25 antibody, or fragment thereof, and the anti-check point inhibitor antibody, or fragment there, can be attached to separate beads, a mixture of which can be used to remove the cells. In other embodiments, the removal of T regulatory cells, e.g., CD25+ cells, and the removal of the check point inhibitor expressing cells is sequential, and can occur, e.g., in either order.

Methods described herein can include a positive selection step. For example, T cells can isolated by incubation with anti-CD3/anti-CD28 (e.g., 3×28)-conjugated beads, such as DYNABEADS® M-450 CD3/CD28 T, for a time period sufficient for positive selection of the desired T cells. In one embodiment, the time period is about 30 minutes. In a further embodiment, the time period ranges from 30 minutes to 36 hours or longer and all integer values there between. In a further embodiment, the time period is at least 1, 2, 3, 4, 5, or 6 hours. In yet another embodiment, the time period is 10 to 24 hours, e.g., 24 hours. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points.

In one embodiment, a T cell population can be selected that expresses one or more of IFN-γ, TNFα, IL-17A, IL-2, IL-3, IL-4, GM-CSF, IL-10, IL-13, granzyme B, and perforin, or other appropriate molecules, e.g., other cytokines. Methods for screening for cell expression can be determined, e.g., by the methods described in PCT Publication No.: WO 2013/126712.

For isolation of a desired population of cells by positive or negative selection, the concentration of cells and surface (e.g., particles such as beads) can be varied. In certain aspects, it may be desirable to significantly decrease the volume in which beads and cells are mixed together (e.g., increase the concentration of cells), to ensure maximum contact of cells and beads. For example, in one aspect, a concentration of 10 billion cells/ml, 9 billion/ml, 8 billion/ml, 7 billion/ml, 6 billion/ml, or 5 billion/ml is used. In one aspect, a concentration of 1 billion cells/ml is used. In yet one aspect, a concentration of cells from 75, 80, 85, 90, 95, or 100 million cells/ml is used. In further aspects, concentrations of 125 or 150 million cells/ml can be used.

Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (e.g., leukemic blood, tumor tissue, etc.). Such populations of cells may have therapeutic value and would be desirable to obtain. For example, using high concentration of cells allows more efficient selection of CD8+ T cells that normally have weaker CD28 expression.

In a related aspect, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In one aspect, the concentration of cells used is $5\times10^6$/ml. In other aspects, the concentration used can be from about $1\times10^5$/ml to $1\times10^6$/ml, and any integer value in between.

In other aspects, the cells may be incubated on a rotator for varying lengths of time at varying speeds at either 2-10° C. or at room temperature.

T cells for stimulation can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

In certain aspects, cryopreserved cells are thawed and washed as described herein and allowed to rest for one hour at room temperature prior to activation using the methods of the present invention.

Also contemplated in the context of the invention is the collection of blood samples or apheresis product from a subject at a time period prior to when the expanded cells as described herein might be needed. As such, the source of the cells to be expanded can be collected at any time point necessary, and desired cells, such as T cells, isolated and frozen for later use in immune effector cell therapy for any number of diseases or conditions that would benefit from immune effector cell therapy, such as those described herein. In one aspect a blood sample or an apheresis is taken from a generally healthy subject. In certain aspects, a blood sample or an apheresis is taken from a generally healthy subject who is at risk of developing a disease, but who has not yet developed a disease, and the cells of interest are isolated and frozen for later use. In certain aspects, the T cells may be expanded, frozen, and used at a later time. In certain aspects, samples are collected from a patient shortly after diagnosis of a particular disease as described herein but prior to any treatments. In a further aspect, the cells are isolated from a blood sample or an apheresis from a subject prior to any number of relevant treatment modalities, including but not limited to treatment with agents such as natalizumab, efalizumab, antiviral agents, chemotherapy, radiation, immunosuppressive agents, such as cyclosporin, azathioprine, methotrexate, mycophenolate, and FK506, antibodies, or other immunoablative agents such as CAMPATH, anti-CD3 antibodies, cytoxan, fludarabine, cyclosporin, FK506, rapamycin, mycophenolic acid, steroids, FR901228, and irradiation.

In a further aspect of the present invention, T cells are obtained from a patient directly following treatment that leaves the subject with functional T cells. In this regard, it has been observed that following certain cancer treatments, in particular treatments with drugs that damage the immune system, shortly after treatment during the period when patients would normally be recovering from the treatment, the quality of T cells obtained may be optimal or improved for their ability to expand ex vivo. Likewise, following ex vivo manipulation using the methods described herein, these cells may be in a preferred state for enhanced engraftment and in vivo expansion. Thus, it is contemplated within the context of the present invention to collect blood cells, including T cells, dendritic cells, or other cells of the hematopoietic lineage, during this recovery phase. Further, in certain aspects, mobilization (for example, mobilization with GM-CSF) and conditioning regimens can be used to create a condition in a subject wherein repopulation, recirculation, regeneration, and/or expansion of particular cell types is favored, especially during a defined window of time following therapy. Illustrative cell types include T cells, B cells, dendritic cells, and other cells of the immune system.

In one embodiment, the immune effector cells expressing a CAR molecule, e.g., a CAR molecule described herein, are obtained from a subject that has received a low, immune enhancing dose of an mTOR inhibitor. In an embodiment, the population of immune effector cells, e.g., T cells, to be engineered to express a CAR, are harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In other embodiments, population of immune effector cells, e.g., T cells, which have, or will be engineered to express a CAR, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

In one embodiment, a T cell population is diaglycerol kinase (DGK)-deficient. DGK-deficient cells include cells that do not express DGK RNA or protein, or have reduced or inhibited DGK activity. DGK-deficient cells can be generated by genetic approaches, e.g., administering RNA-interfering agents, e.g., siRNA, shRNA, miRNA, to reduce or prevent DGK expression. Alternatively, DGK-deficient cells can be generated by treatment with DGK inhibitors described herein.

In one embodiment, a T cell population is Ikaros-deficient. Ikaros-deficient cells include cells that do not express Ikaros RNA or protein, or have reduced or inhibited Ikaros activity, Ikaros-deficient cells can be generated by genetic approaches, e.g., administering RNA-interfering agents, e.g., siRNA, shRNA, miRNA, to reduce or prevent Ikaros expression. Alternatively, Ikaros-deficient cells can be generated by treatment with Ikaros inhibitors, e.g., lenalidomide.

In embodiments, a T cell population is DGK-deficient and Ikaros-deficient, e.g., does not express DGK and Ikaros, or has reduced or inhibited DGK and Ikaros activity. Such DGK and Ikaros-deficient cells can be generated by any of the methods described herein.

In an embodiment, the NK cells are obtained from the subject. In another embodiment, the NK cells are an NK cell line, e.g., NK-92 cell line (Conkwest).

In some aspects, the cells of the invention (e.g., the immune effector cells of the invention, e.g., the CAR-expressing cells of the invention) are induced pluripotent stem cells ("iPSCs") or embryonic stem cells (ESCs), or are T cells generated from (e.g., differentiated from) said iPSC and/or ESC. iPSCs can be generated, for example, by methods known in the art, from peripheral blood T lymphocytes, e.g., peripheral blood T lymphocytes isolated from a healthy volunteer. As well, such cells may be differentiated into T cells by methods known in the art. See e.g., Themeli M. et al., *Nat. Biotechnol.,* 31, pp. 928-933 (2013); doi: 10.1038/nbt.2678; WO2014/165707, the contents of each of which are incorporated herein by reference in their entirety.

Additional Expressed Agents

In another embodiment, a CAR-expressing immune effector cell described herein can further express another agent, e.g., an agent which enhances the activity of a CAR-expressing cell. For example, in one embodiment, the agent can be an agent which inhibits an inhibitory molecule. Examples of inhibitory molecules include PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGF beta, e.g., as described herein. In one embodiment, the agent that inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 or TGF beta, or a fragment of any of these, and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD-1 or a fragment thereof, and a second polypeptide of an intracellular signaling domain described herein (e.g., a CD28, CD27, OX40 or 4-1BB signaling domain described herein and/or a CD3 zeta signaling domain described herein). In embodiments, the agent comprises a first polypeptide of an extracellular domain of an inhibitory molecule and a second polypeptide of an intracellular signaling domain of a costimulatory molecule described herein or primary signaling molecule described herein. Such molecules in which an inhibitory molecule (e.g., a domain of an inhibitory molecule) is associated with a molecule that provides a positive signal (e.g., a domain of a costimulatory molecule or primary signaling molecule) are further described in, for example, WO2013/019615.

In one embodiment, the CAR-expressing immune effector cell described herein can further comprise a second CAR, e.g., a second CAR that includes a different antigen binding domain, e.g., to the same target (e.g., a target described above) or a different target. In one embodiment, the second CAR includes an antigen binding domain to a target expressed on the same cancer cell type as the target of the first CAR. In one embodiment, the CAR-expressing immune effector cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain.

While not wishing to be bound by theory, placement of a costimulatory signaling domain, e.g., 4-1BB, CD28, CD27 or OX-40, onto the first CAR, and the primary signaling domain, e.g., CD3 zeta, on the second CAR can limit the CAR activity to cells where both targets are expressed. In one embodiment, the CAR expressing immune effector cell comprises a first CAR that includes an antigen binding domain that targets, e.g., a target described above, a transmembrane domain and a costimulatory domain and a second CAR that targets an antigen other than antigen targeted by the first CAR (e.g., an antigen expressed on the same cancer cell type as the first target) and includes an antigen binding domain, a transmembrane domain and a primary signaling domain. In another embodiment, the CAR expressing immune effector cell comprises a first CAR that includes an antigen binding domain that targets, e.g., a target described above, a transmembrane domain and a primary signaling domain and a second CAR that targets an antigen other than antigen targeted by the first CAR (e.g., an antigen expressed on the same cancer cell type as the first target) and includes an antigen binding domain to the antigen, a transmembrane domain and a costimulatory signaling domain.

In one embodiment, the CAR-expressing immune effector cell comprises a CAR described herein, e.g., a CAR to a target described above, and an inhibitory CAR. In one embodiment, the inhibitory CAR comprises an antigen binding domain that binds an antigen found on normal cells but not cancer cells, e.g., normal cells that also express the target. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 or TGF beta.

In one embodiment, an immune effector cell (e.g., T cell, NK cell) comprises a first CAR comprising an antigen binding domain that binds to a tumor antigen as described herein, and a second CAR comprising a PD1 extracellular domain or a fragment thereof.

In one embodiment, the cell further comprises an inhibitory molecule as described above.

In one embodiment, the second CAR in the cell is an inhibitory CAR, wherein the inhibitory CAR comprises an antigen binding domain, a transmembrane domain, and an intracellular domain of an inhibitory molecule. The inhibitory molecule can be chosen from one or more of: PD1, PD-L1, CTLA-4, TIM-3, LAG-3, VISTA, BTLA, TIGIT, LAIR1, CD160, 2B4, TGF beta, CEACAM-1, CEACAM-3, and CEACAM-5. In one embodiment, the second CAR molecule comprises the extracellular domain of PD1 or a fragment thereof.

In embodiments, the second CAR molecule in the cell further comprises an intracellular signaling domain comprising a primary signaling domain and/or an intracellular signaling domain.

In other embodiments, the intracellular signaling domain in the cell comprises a primary signaling domain comprising the functional domain of CD3 zeta and a costimulatory signaling domain comprising the functional domain of 4-1BB.

In one embodiment, the second CAR molecule in the cell comprises the amino acid sequence of SEQ ID NO: 6654.

In certain embodiments, the antigen binding domain of the first CAR molecule comprises a scFv and the antigen binding domain of the second CAR molecule does not comprise a scFv. For example, the antigen binding domain of the first CAR molecule comprises a scFv and the antigen binding domain of the second CAR molecule comprises a camelid VHH domain.

In other aspects and embodiments, a cell of the invention, e.g., a cell engineered to express a CAR, is also engineered to express a safety molecule, such as a molecule (or set of molecules) which mediates the depleting of the cells, e.g., CAR T cells, when appropriate (e.g., after the T cells have accomplished the anti-tumor function, or if the T cells are causing life-threatening side effects). In one exemplary aspect, the safety molecule a molecule that does not affect the function of the cell, but which can be targeted by another agent, e.g., an antibody or ADC molecule targeting said molecule. One exemplary embodiment of such a molecule is a truncated receptor, e.g., a receptor comprising the extracellular domain and transmembrane domain of a receptor, but lacking all or a substantial portion of the intracellular domain of the receptor. An example is a truncated EGFR receptor, e.g., as described in WO2011/056894. Without being bound by theory, targeting said truncated EGFR receptor with an anti-EGFR antibody, e.g., cetuximab, will deplete cells expressing the truncated EGFR receptor. A second example is a iCasp9 switch polypeptide, e.g., a polypeptide having a dimerization domain, an optional linker, and a caspase domain oriented such that, when expressed in the presence of a dimerization compound in a mammalian host cell, the iCasp9 switch polypeptide homodimerizes, resulting in apoptosis of the host cell. In embodiments, the dimerization domain is a FKBP-based dimerization domain, e.g., the sequence harbors a mutation (F37V) which provides a complementary fitting cavity for AP1903 and AP1903-structurally related ligands (such as AP20187), which molecules may act as a dimerization compound. Such iCasp9 switch polypeptides (and associated dimerization compounds) are described in, for example, WO1997/031899, US2011/286980, WO2014/164348, WO2013/040371, US2013/071414, WO2014/255360, and N Engl J Med. 2011 Nov. 3; 365(18):1673-83. A third example of such a molecule is a molecule targeted by an anti-CD20 antibody, wherein, for example, administering an anti-CD20 antibody (e.g., rituximab) allows said cells to be depleted. Examples of molecules targeted by an anti-CD20 antibody include CD20, and truncated versions thereof (e.g., molecules comprising an extracellular domain recognizable by an anti-CD20 antibody, a transmembrane domain, and lacking at least a portion of an intracellular domain).

In other aspects and embodiments, the cell of the invention, e.g., a cell engineered to express a CAR, is also engineered to express an NK inhibitory molecule. As used herein, the term "NK inhibitory molecule" refers to a molecule which inhibits a function, e.g., a cytolytic function, of NK cells. Without being bound by theory, it is believed that a cell, e.g., a cell of the invention, which has reduced or eliminated expression of one or more MHC class I molecules (e.g., which have reduced or eliminated expression of B2M, NLRC5 and/or CIITA, e.g., by introduction of a CRISPR system targeting B2M, NLRC5 and/or CIITA as described herein into said cell) may be recognized by NK cells as non-self, and targeted for cytolysis. Thus, expression of one or more NK inhibitory molecules on said cell protects it from NK cell destruction. In one aspect, the NK inhibitory molecule is a ligand for an NK inhibitory receptor. Non-limiting examples of NK inhibitory receptors include NK cell surface receptors which have or which associate with an immunoreceptor tyrosine-based inhibitory motif (ITIM). Non-limiting examples of such receptors include 2B4 (also known as CD244); a member of the NK-cell-receptor protein 1 (NKR-P1) family (e.g., NKR-P1A, NKR-P1B, NKR-P1C, NKR-P1D, NKR-P1E and NKR-P1F, e.g., NKR-P1B and NKR-P1D); a member of the carcinoembryonic-antigen-related cell-adhesion molecule (CEACAM) family (e.g., CEACAM1); Sialic acid-binding immunoglobulin-like lectin (SIGLEC) family members (e.g., SIGLEC7 and SIGLEC9); Leukocyte-associated immunoglobulin-like receptor 1 (LAIR1); Glycoprotein 49 B1 (gp49B1) or human homolog thereof; CD81; and a member of the signal-regulatory protein (SIRP) family. In embodiments, the NK inhibitory molecule is a non-MHC class I molecule. Non-limiting examples of NK inhibitory molecules include ligands for the aforementioned receptors, e.g., CD48, a member of the C-type lectin-related family (e.g., CLR-B (also known as OCIL), CLR-F and CLR-G (also known as OCILrP2)), CEACAM1, a polypeptide displaying sialic acid, and alpha V beta 3 integrin. In embodiments, the NK inhibitory molecule is a fragment of a naturally occurring molecule, e.g., comprises the extracellular domain and transmembrane domain of the NK inhibitory molecule, but lacks the all or a portion of the intracellular domain (e.g., lacks an intracellular ITIM or inhibitory domain). In other embodiments, the NK inhibitory molecule is an HLA-G molecule. HLA-G has been shown to arrest or reduce the function of the immune system, e.g., NK cells. Carosella et al., *Advances in Immunol.*, vol. 127, pp. 33-144, 2015; Torikai H. et al., *Blood.*, vol. 122(8), pp. 1341-1349, 2013. Without being bound by theory, the presence of HLA-G on the surface of a CAR-expressing cell, e.g., an allogeneic CAR-expressing cell, e.g., as described herein, e.g., a CAR-expressing cell that has reduced or eliminated expression of TCR, (B2M or NLRC5) and/or CIITA, e.g., as described herein, may protect the cell from NK cell attack. In embodiments, the NK inhibitory molecule is an isoform of HLA-G that does not require B2M, e.g., HLA-G2, HLA-G3, HLA-G4. Such embodiments are preferred with the cell of the invention, e.g., as described herein comprises an agent or system (e.g., a CRISPR/Cas system, e.g., as described herein) which inhibits the function and/or expression of B2M. Alternatively, in other embodiments in which the cell of the invention, e.g., as described herein, comprises (or at any time comprised) an agent or system (e.g., a CRISPR/Cas system, e.g., as described herein) which inhibits the function and/or expression of B2M (i.e., a cell in which the function and/or expression of B2M has been reduced or eliminated, e.g., as described herein), the NK inhibitory molecule may be an HLA-G molecule which under natural conditions forms a complex with B2M, provided that the NK inhibitory molecule comprises a fusion with a B2M molecule. Such fusions, and methods for their creation, are known in the art. See, e.g., Favier B, HoWangYin K Y, Wu J, Caumartin J, Daouya M, et al. (2011) Tolerogenic Function of Dimeric Forms of HLA-G Recombinant Proteins: A Comparative Study In Vivo. PLoS ONE 6(7): e21011. doi:10.1371/journal.pone.0021011. In such embodiments, to the extent the gene encoding the HLA-G:B2M fusion molecule comprises a B2M-encoding sequence which comprises a target sequence of a B2M targeting gRNA molecule, the sequence of said nucleic acid may be altered to reduce or eliminate binding of the gRNA to the HLA-G:B2M fusion-encoding nucleic acid so that expression and/or function of the HLA-G:B2M fusion is not reduced or eliminated. In embodiments, the HLA-G:B2M fusion may further comprise a transmembrane domain or sequence suitable for attachment of a membrane anchor molecule (such as a GPI anchor). An exemplary HLA-G:B2M fusion molecule (e.g., an HLA-G1:B2M fusion molecule) is provided below ((G4S)3 linker (SEQ ID NO: 6594) is indicated in bold text). The linker may be present or absent, and may alternatively comprise any peptidic linker, e.g., as described herein). This particular construct has the format B2M-linker ((G4S)3)-HLA-G:

SEQ ID NO: 10674
MSRSVALAVLALLSLSGLEAIQRTPKIQVYSRHPAENGKSNFLNCYVSG

FHPSDIEVDLLKNGERIEKVEHSDLSFSKDWSFYLLYYTEFTPTEKDEY

ACRVNHVTLSQPKIVKWDRDMGGGGSGGGGSGGGGSGSHSMRYFSAAVS

RPGRGEPRFIAMGYVDDTQFVRFDSDSACPRMEPRAPWVEQEGPEYWEE

ETRNTKAHAQTDRMNLQTLRGYYNQSEASSHTLQWMIGCDLGSDGRLLR

GYEQYAYDGKDYLALNEDLRSWTAADTAAQISKRKCEAANVAEQRRAYL

EGTCVEWLHRYLENGKEMLQRADPPKTHVTHHPVFDYEATLRCWALGFY

PAEIILTWQRDGEDQTQDVELVETRPAGDGTFQKWAAVVVPSGEEQRYT

CHVQHEGLPEPLMLRWKQSSLPTIPIMGIVAGLVVLAAVVTGAAVAAVL

WRKKSSD

An exemplary codon-optimized nucleic acid sequence encoding the above HLA-G:B2M fusion is provided below:

SEQ ID NO: 10675
GCC ACC ATG AGC AGA TCT GTG GCC CTG GCT GTG CTG

GCC CTG CTG TCT CTG TCT GGC CTG GAA GCC ATC CAG

CGG ACC CCC AAG ATC CAG GTG TAC AGC AGA CAC CCC

GCC GAA AAC GGC AAG AGC AAC TTC CTG AAC TGC TAC

GTG TCC GGC TTC CAC CCC AGC GAC ATC GAG GTG GAC

CTG CTG AAG AAC GGC GAG CGG ATC GAA AAG GTG GAA

CAT AGC GAC CTG AGC TTC AGC AAG GAC TGG TCC TTC

TAC CTG CTG TAC TAC ACC GAG TTC ACC CCC ACC GAA

AAG GAC GAG TAC GCC TGC AGA GTG AAC CAC GTG ACC

CTG AGC CAG CCC AAG ATC GTG AAG TGG GAC CGG GAT

ATG GGC GGA GGC GGA TCC GGC GGC GGA GGA TCA GGG

GGG GGA GGG TCC GGA TCC CAC AGC ATG CGG TAC TTC

TCT GCC GCC GTG TCC AGA CCT GGA AGA GGC GAG CCC

CGG TTT ATC GCC ATG GGC TAC GTG GAC GAC ACC CAG

TTC GTC AGA TTC GAC AGC GAC AGC GCC TGC CCC CGG

ATG GAA CCT AGA GCA CCT TGG GTG GAA CAG GAA GGC

CCC GAG TAC TGG GAG GAA GAG ACA CGG AAC ACC AAG

GCC CAC GCC CAG ACC GAC AGA ATG AAC CTG CAG ACC

CTG CGG GGC TAC TAC AAC CAG AGC GAG GCC AGC AGC

CAC ACC CTG CAG TGG ATG ATC GGC TGC GAT CTG GGC

AGC GAC GGC AGA CTG CTG AGA GGT TAC GAA CAG TAC

GCC TAC GAC GGC AAG GAC TAC CTG GCC CTG AAC GAG

GAC CTG CGG TCT TGG ACA GCC GCC GAT ACA GCC GCC

CAG ATC AGC AAG AGA AAG TGC GAG GCC GCC AAC GTG

GCC GAG CAG AGA AGG GCT TAC CTG GAA GGC ACC TGT

GTG GAA TGG CTG CAT AGA TAC CTG GAA AAC GGC AAA

GAG ATG CTG CAG CGG GCC GAC CCC CCT AAG ACA CAC

GTG ACA CAC CAC CCC GTG TTC GAC TAC GAG GCC ACC

CTG AGA TGT TGG GCC CTG GGC TTC TAT CCT GCC GAG

ATC ATC CTG ACC TGG CAG AGG GAT GGC GAG GAC CAG

ACC CAG GAC GTG GAA CTG GTG GAA ACC AGA CCT GCC

```
                            -continued
GGC GAC GGC ACC TTC CAG AAA TGG GCT GCT GTG GTG

GTG CCC AGC GGC GAA GAA CAG AGA TAC ACC TGT CAC

GTG CAG CAC GAG GGC CTG CCC GAA CCC CTG ATG CTG

AGA TGG AAG CAG AGC AGC CTG CCC ACC ATC CCC ATC

ATG GGA ATC GTG GCC GGA CTG GTG GTG CTG GCC GCT

GTC GTG ACA GGC GCT GCA GTG GCC GCC GTG CTG TGG

CGG AAG AAG TCC AGC GAC TAA
```

Another exemplary HLA-G molecule, which may be combined with a B2M sequence, or used without, is provided below (optional leader sequence is indicated in bold text):

SEQ ID NO: 10676

MVVMAPRTLFLLLSGALTLTETWAGSHSMRYFSAAVSRPSRGEPRFIAM

GYVDDTQFVRFDSDSACPRMEPRAPWVEREGPEYWEEETRNTKAHAQTD

RMNLQTLRGYYNQSEASSHTLQWMIGCDLGSDGRLLRGYEQYAYDGKDY

LALNEDLRSWTAADTAAQISKRKCEAANVAEQRRAYLEGTCVEWLHRYL

ENGKEMLQRADPPKTHVTHHPVFDYEATLRCWALGFYPAEIILTWQRDG

EDQTQDVELVETKPAGDGTFQKWAAVVVPSGEEQRYTCHVQHEGLPEPL

MLRWKQSSLPTIPIMGIVAGLVVLAAVVTGAAVAAVLWRKKSSD

In other embodiments where the NK inhibitory molecule requires B2M, and it is desirable to reduce or eliminate expression of one or more HLA Class I molecules, a CRISPR/Cas system (e.g., as described herein) may be used which comprises a gRNA comprising a targeting domain which is complementary to a target sequence of NLRC5 (human NLRC5: Entrez 84166; UniProt Q86WI3) or its regulatory elements, e.g., a gRNA which comprises a targeting domain listed in Table 1 to NLRC5 (or a fragment of such targeting domain, e.g., the 3' 20 nucleotides of such targeting domain, listed in Table 1 to NLRC5; e.g., a gRNA comprising a targeting domain comprising of any one of SEQ ID NO: 8622 to SEQ ID NO: 10089 or fragment (e.g., 3' 20 nucleotide fragment) thereof). Without being bound by theory, it is believed that reduced or eliminated expression and/or function of NLRC5 will reduce or eliminate expression and/or function of one or more MHC Class I molecules, even in the presence of B2M. See e.g., Downs, I., Vijayan, S., Sidiq, T. and Kobayashi, K. S. (2016), CITA/NLRC5: A critical transcriptional regulator of MHC class I gene expression. *BioFactors*, 42: 349-357. doi:10.1002/biof.1285.

In other embodiements, the NK inhibitory molecule is a membrane-bound isoform of HLA-G, e.g., HLA-G1, HLA-G2, HLA-G3 and/or HLA-G4. In other embodiments, the NK inhibitory molecule is a soluble isoform of HLA-G, e.g., sHLA-G1 (shed), HLA-G5, HLA-G6, and/or HLA-G7. In embodiments, the NK inhibitory molecule is selected from one or more of HLA-G2, HLA-G3 and HLA-G4. In an embodiment, the NK inhibitory molecule is HLA-G2.

In other embodiments, the NK inhibitory molecule is an HLA-E molecule. HLA-E has been shown to arrest or reduce the function of NK cells against HLA Class I-negative cells. Torikai H. et al., *Blood*, vol. 122(8), pp. 1341-1349, 2013. Without being bound by theory, the presence of HLA-E on the surface of a CAR-expressing cell, e.g., an allogeneic CAR-expressing cell, e.g., as described herein, e.g., a CAR-expressing cell that has reduced or eliminated expression of TCR, (B2M or NLRC5) and/or CIITA, e.g., as described herein, may protect the cell from NK cell attack. In an embodiment, the NK inhibitory molecule is an HLA-G molecule and an HLA-E molecule.

In embodiments where the cell of the invention, e.g., the CAR expressing cell of the invention, e.g., as described herein, is engineered to express an NK inhibitory molecule, the cell may be further engineered to reduce or eliminate expression and/or function of one or more ligands or binding partners of said NK inhibitory molecule (herein referred to as "target of an NK inhibitory molecule"). Without being bound by theory, it is believed that reduction or elimination of expression and/or function, e.g., surface expression, of a target of an NK inhibitory molecule will reduce or avoid inhibition of the cell of interest, e.g., the CAR expressing cell of the invention, e.g., as described herein, by the expression of the NK inhibitory molecule, thereby improving the function of the cell of the invention, e.g., the CAR expressing cell of the invention, e.g., as described herein. In other embodiments, the inhibitory effects of the NK inhibitory molecule may be reduced or eliminated in the cell of interest, e.g., the CAR expressing cell of the invention, e.g., as described herein, by expressing a dominant negative mutant or fragment of the target of an NK inhibitory molecule, e.g., a target of an NK inhibitory molecule which has a modified or eliminated (partially or wholly) intracellular inhibitory domain (e.g., one or more ITIM domains), such that the inhibitory signal is not propagated upon binding of the NK inhibitory molecule. In embodiments where the NK inhibitory molecule is an HLA-G molecule, e.g., as described herein, the target of an NK inhibitory molecule is LILRB1 (e.g., human LILRB1: Entrez: 10859; UniProt Q8NHL6). In embodiments, the reduction or elimination of expression and/or function of the target of an NK inhibitory molecule, e.g., LILRB1, is accomplished by introducing a nucleic acid inhibitor of the target of an NK inhibitory molecule (e.g., an shRNA or siRNA molecule specific for LILRB1). In other embodiments, the reduction or elimination of expression and/or function of the target of an NK inhibitory molecule, e.g., LILRB1, is accomplished by introducing a gene editing system, e.g. a CRISPR/Cas gene editing system, e.g., as described herein, which recognizes a target sequence in the gene or its regulatory elements of the target of an NK inhibitory molecule (e.g., recognizes a target sequence in the LILRB1 gene or its regulatory elements), such that expression and/or function of the target of an NK inhibitory molecule, e.g., LILRB1, is reduced or eliminated. In embodiments, where the target of an NK inhibitory molecule is LILRB1, the gene editing system is a CRISPR/Cas system, e.g., as described herein, comprising a gRNA molecule comprising a targeting domain listed in Table 6d (or, as described herein, comprising a fragment, e.g., a 20 nucleotide fragment, e.g., the 3' 20 nucleotides, of a targeting domain listed in Table 6d).

In embodiments and aspects, the invention relates to a cell, e.g., an immune effector cell, (or population of said cells) comprising nucleic acid encoding an NK inhibitory molecule, e.g., such that the NK inhibitory molecule is expressed in said cell, e.g., comprises nucleic acid encoding an NK inhibitory molecule operably linked to a promoter operable in the cell. In embodiments, the nucleic acid molecule encoding an NK inhibitory molecule comprises additional sequence encoding a CAR. In embodiments, the nucleic acid sequence encoding an NK inhibitory molecule and the nucleic acid sequence encoding a CAR are operably linked to separate promoters, as described herein. In other embodiments, an NK inhibitory molecule the nucleic acid sequence encoding an NK inhibitory molecule and the nucleic acid sequence encoding a CAR are expressed from a single promoter, optionally with a sequence encoding a cleavable peptide (e.g., a 2A peptide) disposed between the sequences encoding the two molecules.

The cell of the invention, e.g., the cells engineered to express a CAR, may be engineered to express more than one of the additional molecules described above. In embodiments, the cell is engineered to express a CAR, e.g., as described herein, an iCasp9 switch polypeptide and an NK inhibitory molecule.

In embodiments and aspects, a cell of the invention, e.g., an immune effector cell (or population of said cells), e.g., a CAR-expressing cell as described herein, has reduced or eliminated expression of the protein comprising the target antigen of the CAR molecule (e.g., a target antigen described herein). Such reduced or eliminated expression of the protein comprising the target antigen of the CAR molecule may be affected, by for example, introducing a mutation (e.g., an indel) within the gene sequence encoding said protein comprising the target antigen (or its regulatory elements) using a gene editing system, e.g., a CRISPR gene editing system (e.g., comprising a gRNA molecule complementary to a target sequence within said gene), e.g., described herein. Without being bound by theory, reduced or eliminated expression of the protein comprising the target antigen of the CAR molecule may protect said CAR-expressing cells from self-recognition and/or attack. In embodiments, the reduced or eliminated expression of said protein comprising the target antigen of the CAR molecule is relative to the expression of said protein comprising the target antigen of the CAR molecule in a resting cell, e.g., resting T cell. In other embodiments, the reduced or eliminated expression of said protein comprising the target antigen of the CAR molecule is relative to the expression of said protein comprising the target antigen of the CAR molecule in an activated cell, e.g., an activated T cell, e.g., a T cell activated by CD3 and/or CD28 stimulation, or by activation through signaling of the CAR molecule.

Split CAR

In some embodiments, the CAR-expressing cell uses a split CAR. The split CAR approach is described in more detail in publications WO2014/055442 and WO2014/055657. Briefly, a split CAR system comprises a cell expressing a first CAR having a first antigen binding domain and a costimulatory domain (e.g., 41BB), and the cell also expresses a second CAR having a second antigen binding domain and an intracellular signaling domain (e.g., CD3 zeta). When the cell encounters the first antigen, the costimulatory domain is activated, and the cell proliferates. When the cell encounters the second antigen, the intracellular signaling domain is activated and cell-killing activity begins. Thus, the CAR-expressing cell is only fully activated in the presence of both antigens.

Multiple CAR Expression

In one aspect, the CAR-expressing cell described herein can further comprise a second CAR, e.g., a second CAR that includes a different antigen binding domain, e.g., to the same target or a different target (e.g., a target other than a cancer associated antigen described herein or a different cancer associated antigen described herein). In one embodiment, the second CAR includes an antigen binding domain to a target expressed the same cancer cell type as the cancer associated antigen. In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. While not wishing to be bound by theory, placement of a costimulatory signaling domain, e.g., 4-1BB, CD28, CD27 or OX-40, onto the first CAR, and the primary signaling domain, e.g., CD3 zeta, on the second CAR can limit the CAR activity to cells where both targets are expressed. In one embodiment, the CAR expressing cell comprises a first cancer associated antigen CAR that includes an antigen binding domain that binds a target antigen described herein, a transmembrane domain and a costimulatory domain and a second CAR that targets a different target antigen (e.g., an antigen expressed on that same cancer cell type as the first target antigen) and includes an antigen binding domain, a transmembrane domain and a primary signaling domain. In another embodiment, the CAR expressing cell comprises a first CAR that includes an antigen binding domain that binds a target antigen described herein, a transmembrane domain and a primary signaling domain and a second CAR that targets an antigen other than the first target antigen (e.g., an antigen expressed on the same cancer cell type as the first target antigen) and includes an antigen binding domain to the antigen, a transmembrane domain and a costimulatory signaling domain.

In some embodiments, the claimed invention comprises a first and second CAR, wherein the antigen binding domain of one of said first CAR said second CAR does not comprise a variable light domain and a variable heavy domain. In some embodiments, the antigen binding domain of one of said first CAR said second CAR is an scFv, and the other is not an scFv. In some embodiments, the antigen binding domain of one of said first CAR said second CAR comprises a single VH domain, e.g., a camelid, shark, or lamprey single VH domain, or a single VH domain derived from a human or mouse sequence. In some embodiments, the antigen binding domain of one of said first CAR said second CAR comprises a nanobody. In some embodiments, the antigen binding domain of one of said first CAR said second CAR comprises a camelid VHH domain.

Telomerase Expression

While not wishing to be bound by any particular theory, in some embodiments, a therapeutic T cell has short term persistence in a patient, due to shortened telomeres in the T cell; accordingly, transfection with a telomerase gene can lengthen the telomeres of the T cell and improve persistence of the T cell in the patient. See Carl June, "Adoptive T cell therapy for cancer in the clinic", Journal of Clinical Investigation, 117:1466-1476 (2007). Thus, in an embodiment, an immune effector cell, e.g., a T cell, ectopically expresses a telomerase subunit, e.g., the catalytic subunit of telomerase, e.g., TERT, e.g., hTERT. In some aspects, this disclosure provides a method of producing a CAR-expressing cell, comprising contacting a cell with a nucleic acid encoding a telomerase subunit, e.g., the catalytic subunit of telomerase, e.g., TERT, e.g., hTERT. The cell may be contacted with the nucleic acid before, simultaneous with, or after being contacted with a construct encoding a CAR.

In embodiments in which a cell is engineered to express more than one molecule, sequence encoding each of said molecules (e.g., sequence encoding a CAR and sequence encoding an NK inhibitory molecule) can be disposed on the same nucleic acid molecule, e.g., the same plasmid or vector, e.g., viral vector, e.g., lentiviral vector. In an embodiment, (i) sequence encoding a CAR, as described herein, and (ii) sequence encoding an NK inhibitory molecule, as described herein, can be present on the same nucleic acid, e.g., vector. Production of the corresponding proteins can be achieved, e.g., by the use of separate promoters, or by the use of a bicistronic transcription product (which can result in the production of two proteins by cleavage of a single translation product or by the translation of two separate protein products). In an embodiment, a sequence encoding a cleavable peptide, e.g., a P2A, T2A or F2A sequence, is disposed between (i) and (ii). In an embodiment, a sequence encoding an IRES, e.g., an EMCV or EV71 IRES, is disposed between (i) and (ii). In these embodiments, (i) and (ii) are transcribed as a single RNA. In other aspects, each molecule may be expressed from a different promoter. In an embodiment, a first promoter is operably linked to (i) and a second promoter is operably linked to (ii), such that (i) and (ii) are transcribed as separate mRNAs.

Alternatively, the sequence encoding the more than one molecules can be disposed on the different nucleic acid molecules, e.g., different plasmids or vectors, e.g., viral vector, e.g., lentiviral vector. E.g., the (i) sequence encoding a CAR as described herein can be present on a first nucleic acid, e.g., a first vector, and the (ii) sequence encoding a NK inhibitory molecule can be present on the second nucleic acid, e.g., the second vector.

TABLE 7

Exemplary sequences of various components of CAR (aa-amino acids, na-nucleic acids that encodes the corresponding protein)

| SEQ ID NO | description | Sequence | Corresp. To huCD19 |
|---|---|---|---|
| 6639 | EF-1 promoter | CGTGAGGCTCCGGTGCCCGTCAGTGGGCAGAGCGCACA TCGCCCACAGTCCCCGAGAAGTTGGGGGGAGGGGTCGG CAATTGAACCGGTGCCTAGAGAAGGTGGCGCGGGGTAA ACTGGGAAAGTGATGTCGTGTACTGGCTCCGCCTTTTC CCGAGGGTGGGGGAGAACCGTATATAAGTGCAGTAGTC GCCGTGAACGTTCTTTTTCGCAACGGGTTTGCCGCCAGA ACACAGGTAAGTGCCGTGTGTGGTTCCCGCGGGCCTGG CCTCTTTACGGGTTATGGCCCTTGCGTGCCTTGAATTAC TTCCACCTGGCTGCAGTACGTGATTCTTGATCCCGAGCT TCGGGTTGGAAGTGGGTGGGAGAGTTCGAGGCCTTGCG CTTAAGGAGCCCCTTCGCCTCGTGCTTGAGTTGAGGCCT GGCCTGGGCGCTGGGGCCGCCGCGTGCGAATCTGGTGG CACCTTCGCGCCTGTCTCGCTGCTTTCGATAAGTCTCTA GCCATTTAAAATTTTTGATGACCTGCTGCGACGCTTTTT TTCTGGCAAGATAGTCTTGTAAATGCGGGCCAAGATCT GCACACTGGTATTTCGGTTTTTGGGGCCGCGGGCGGCG ACGGGGCCCGTGCGTCCCAGCGCACATGTTCGGCGAGG CGGGGCCTGCGAGCGCGGCCACCGAGAATCGGACGGG GGTAGTCTCAAGCTGGCCGGCCTGCTCTGGTGCCTGGC CTCGCGCCGCCGTGTATCGCCCCGCCCTGGGCGGCAAG GCTGGCCCGGTCGGCACCAGTTGCGTGAGCGGAAAGAT GGCCGCTTCCCGGCCCTGCTGCAGGGAGCTCAAAATGG AGGACGCGGCGCTCGGGAGAGCGGGCGGGTGAGTCAC CCACACAAAGGAAAAGGGCCTTTCCGTCCTCAGCCGTC GCTTCATGTGACTCCACGGAGTACCGGGCGCCGTCCAG GCACCTCGATTAGTTCTCGAGCTTTTGGAGTACGTCGTC TTTAGGTTGGGGGAGGGGTTTTATGCGATGGAGTTTC CCCACACTGAGTGGGTGGAGACTGAAGTTAGGCCAGCT TGGCACTTGATGTAATTCTCCTTGGAATTTGCCCTTTTT GAGTTTGGATCTTGGTTCATTCTCAAGCCTCAGACAGTG GTTCAAAGTTTTTTCTTCCATTTCAGGTGTCGTGA | 100 |
| 6640 | Leader (aa) | MALPVTALLLPLALLLHAARP | 13 |
| 6641 | Leader (na) | ATGGCCCTGCCTGTGACAGCCCTGCTGCTGCCTCTGGCT CTGCTGCTGCATGCCGCTAGACCC | 54 |
| 10802 | Leader (na) | ATGGCCCTCCCTGTCACCGCCCTGCTGCTTCCGCTGGCT CTTCTGCTCCACGCCGCTCGGCCC | |
| 6642 | CD 8 hinge (aa) | TTTPAPRPPTPAPTIASQPLSLRPEACRPAAGGAVHTRGLD FACD | 14 |
| 6643 | CD8 hinge (na) | ACCACGACGCCAGCGCCGCGACCACCAACACCGGCGCC CACCATCGCGTCGCAGCCCCTGTCCCTGCGCCCAGAGG CGTGCCGGCCAGCGGCGGGGGGCGCAGTGCACACGAG GGGGCTGGACTTCGCCTGTGAT | 55 |
| 6630 | Ig4 hinge (aa) | ESKYGPPCPPCPAPEFLGGPSVFLFPPKPKDTLMISRTPEVT CVVVDVSQEDPEVQFNWYVDGVEVHNAKTKPREEQFNS TYRVVSVLTVLHQDWLNGKEYKCKVSNKGLPSSIEKTISK AKGQPREPQVYTLPPSQEEMTKNQVSLTCLVKGFYPSDIA VEWESNGQPENNYKTTPPVLDSDGSFFLYSRLTVDKSRW QEGNVFSCSVMHEALHNHYTQKSLSLSLGKM | 102 |

TABLE 7-continued

Exemplary sequences of various components of CAR (aa-amino acids, na-nucleic acids that encodes the corresponding protein)

| SEQ ID NO | description | Sequence | Corresp. To huCD19 |
|---|---|---|---|
| 6631 | Ig4 hinge (na) | GAGAGCAAGTACGGCCCTCCCTGCCCCCCTTGCCCTGC CCCCGAGTTCCTGGGCGGACCCAGCGTGTTCCTGTTCCC CCCCAAGCCCAAGGACACCCTGATGATCAGCCGGACCC CCGAGGTGACCTGTGTGGTGGTGGACGTGTCCCAGGAG GACCCCGAGGTCCAGTTCAACTGGTACGTGGACGGCGT GGAGGTGCACAACGCCAAGACCAAGCCCCGGGAGGAG CAGTTCAATAGCACCTACCGGGTGGTGTCCGTGCTGAC CGTGCTGCACCAGGACTGGCTGAACGGCAAGGAATACA AGTGTAAGGTGTCCAACAAGGGCCTGCCCAGCAGCATC GAGAAAACCATCAGCAAGGCCAAGGGCCAGCCTCGGG AGCCCCAGGTGTACACCCTGCCCCCTAGCCAAGAGGAG ATGACCAAGAACCAGGTGTCCCTGACCTGCCTGGTGAA GGGCTTCTACCCCAGCGACATCGCCGTGGAGTGGGAGA GCAACGGCCAGCCCGAGAACAACTACAAGACCACCCCC CCTGTGCTGGACAGCGACGGCAGCTTCTTCCTGTACAG CCGGCTGACCGTGGACAAGAGCCGGTGGCAGGAGGGC AACGTCTTTAGCTGCTCCGTGATGCACGAGGCCCTGCA CAACCACTACACCCAGAAGAGCCTGAGCCTGTCCCTGG GCAAGATG | 103 |
| 6632 | IgD hinge (aa) | RWPESPKAQASSVPTAQPQAEGSLAKATTAPATTRNTGR GGEEKKKEKEKEEQEERETKTPECPSHTQPLGVYLLTPAV QDLWLRDKATFTCFVVGSDLKDAHLTWEVAGKVPTGGV EEGLLERHSNGSQSQHSRLTLPRSLWNAGTSVTCTLNHPS LPPQRLMALREPAAQAPVKLSLNLLASSDPPEAASWLLCE VSGFSPPNILLMWLEDQREVNTSGFAPARPPPQPGSTTFW AWSVLRVPAPPSPQPATYTCVVSHEDSRTLLNASRSLEVS YVTDH | 47 |
| 6633 | IgD hinge (na) | AGGTGGCCCGAAAGTCCCAAGGCCCAGGCATCTAGTGT TCCTACTGCACAGCCCCAGGCAGAAGGCAGCCTAGCCA AAGCTACTACTGCACCTGCCACTACGCGCAATACTGGC CGTGGCGGGGAGGAGAAGAAAAAGGAGAAAGAGAAA GAAGAACAGGAAGAGAGGGAGACCAAGACCCCTGAAT GTCCATCCCATACCCAGCCGCTGGGCGTCTATCTCTTGA CTCCCGCAGTACAGGACTTGTGGCTTAGAGATAAGGCC ACCTTTACATGTTTCGTCGTGGGCTCTGACCTGAAGGAT GCCCATTTGACTTGGGAGGTTGCCGGAAAGGTACCCAC AGGGGGGGTTGAGGAAGGGTTGCTGGAGCGCCATTCCA ATGGCTCTCAGAGCCAGCACTCAAGACTCACCCTTCCG AGATCCCTGTGGAACGCCGGGACCTCTGTCACATGTAC TCTAAATCATCCTAGCCTGCCCCCACAGCGTCTGATGGC CCTTAGAGAGCCAGCCGCCCAGGCACCAGTTAAGCTTA GCTGAATCTGCTCGCCAGTAGTGATCCCCCAGAGGCC GCCAGCTGGCTCTTATGCGAAGTGTCCGGCTTTAGCCCG CCCAACATCTTGCTCATGTGGCTGGAGGACCAGCGAGA AGTGAACACCAGCGGCTTCGCTCCAGCCCGGCCCCCAC CCCAGCCGGGTTCTACCACATTCTGGGCCTGGAGTGTCT TAAGGGTCCAGCACCACCTAGCCCCCAGCCAGCCACA TACACCTGTGTTGTGTCCCATGAAGATAGCAGGACCCT GCTAAATGCTTCTAGGAGTCTGGAGGTTTCCTACGTGAC TGACCATT | 48 |
| 6634 | GS hinge/linker (aa) | GGGGSGGGGS | 49 |
| 6635 | GS hinge/linker (na) | GGTGGCGGAGGTTCTGGAGGTGGAGGTTCC | 50 |
| 6644 | CD8TM (aa) | IYIWAPLAGTCGVLLLSLVITLYC | 15 |
| 6645 | CD8 TM (na) | ATCTACATCTGGGCGCCCTTGGCCGGGACTTGTGGGGT CCTTCTCCTGTCACTGGTTATCACCCTTTACTGC | 56 |
| 10803 | CD8 TM (na) | ATCTACATTTGGGCCCCTCTGGCTGGTACTTGCGGGGTC CTGCTGCTTTCACTCGTGATCACTCTTTACTGT | |
| 6646 | 4-1BB intracellular domain (aa) | KRGRKKLLYIFKQPFMRPVQTTQEEDGCSCRFPEEEEGGC EL | 16 |

TABLE 7-continued

Exemplary sequences of various components of CAR (aa-amino acids, na-nucleic acids that encodes the corresponding protein)

| SEQ ID NO | description | Sequence | Corresp. To huCD19 |
|---|---|---|---|
| 6647 | 4-1BB intracellular domain (na) | AAACGGGGCAGAAAGAAACTCCTGTATATATTCAAACA ACCATTTATGAGACCAGTACAAACTACTCAAGAGGAAG ATGGCTGTAGCTGCCGATTTCCAGAAGAAGAAGAAGGA GGATGTGAACTG | 60 |
| 10804 | 4-1BB intracellular domain (na) | AAGCGCGGTCGGAAGAAGCTGCTGTACATCTTTAAGCA ACCCTTCATGAGGCCTGTGCAGACTACTCAAGAGGAGG ACGGCTGTTCATGCCGGTTCCCAGAGGAGGAGGAAGGC GGCTGCGAACTG | |
| 6636 | CD27 (aa) | QRRKYRSNKGESPVEPAEPCRYSCPREEEGSTIPIQEDYRK PEPACSP | 51 |
| 6637 | CD27 (na) | AGGAGTAAGAGGAGCAGGCTCCTGCACAGTGACTACAT GAACATGACTCCCCGCCGCCCCGGGCCCACCCGCAAGC ATTACCAGCCCTATGCCCCACCACGCGACTTCGCAGCCT ATCGCTCC | 52 |
| 6648 | CD3-zeta (aa) | RVKFSRSADAPAYKQGQNQLYNELNLGRREEYDVLDKRR GRDPEMGGKPRRKNPQEGLYNELQKDKMAEAYSEIGMK GERRRGKGHDGLYQGLSTATKDTYDALHMQALPPR | 17 |
| 6649 | CD3-zeta (na) | AGAGTGAAGTTCAGCAGGAGCGCAGACGCCCCCGCGTA CAAGCAGGGCCAGAACCAGCTCTATAACGAGCTCAATC TAGGACGAAGAGAGGAGTACGATGTTTTGGACAAGAG ACGTGGCCGGGACCCTGAGATGGGGGGAAAGCCGAGA AGGAAGAACCCTCAGGAAGGCCTGTACAATGAACTGCA GAAAGATAAGATGGCGGAGGCCTACAGTGAGATTGGG ATGAAAGGCGAGCGCCGGAGGGGCAAGGGGCACGATG GCCTTTACCAGGGTCTCAGTACAGCCACCAAGGACACC TACGACGCCCTTCACATGCAGGCCCTGCCCCCTCGC | 101 |
| 10805 | CD3-zeta (na) | CGCGTGAAATTCAGCCGCAGCGCAGATGCTCCAGCCTA CAAGCAGGGGCAGAACCAGCTCTACAACGAACTCAATC TTGGTCGGAGAGAGGAGTACGACGTGCTGGACAAGCG GAGAGGACGGGACCCAGAAATGGGCGGGAAGCCGCGC AGAAAGAATCCCCAAGAGGGCCTGTACAACGAGCTCCA AAAGGATAAGATGGCAGAAGCCTATAGCGAGATTGGT ATGAAAGGGAACGCAGAAGAGGCAAAGGCCACGACG GACTGTACCAGGGACTCAGCACCGCCACCAAGGACACC TATGACGCTCTTCACATGCAGGCCCTGCCGCCTCGG | |
| 6650 | CD3-zeta (aa) | RVKFSRSADAPAYQQGQNQLYNELNLGRREEYDVLDKRR GRDPEMGGKPRRKNPQEGLYNELQKDKMAEAYSEIGMK GERRRGKGHDGLYQGLSTATKDTYDALHMQALPPR | 43 |
| 6651 | CD3-zeta (na) | AGAGTGAAGTTCAGCAGGAGCGCAGACGCCCCCGCGTA CCAGCAGGGCCAG AACCAGCTCTATAACGAGCTCAATCTAGGACGAAGAGA GGAGTACGATGTTT TGGACAAGAGACGTGGCCGGGACCCTGAGATGGGGGG AAAGCCGAGAAGGA AGAACCCTCAGGAAGGCCTGTACAATGAACTGCAGAAA GATAAGATGGCGG AGGCCTACAGTGAGATTGGGATGAAAGGCGAGCGCCG GAGGGGCAAGGGGC ACGATGGCCTTTACCAGGGTCTCAGTACAGCCACCAAG GACACCTACGACGC CCTTCACATGCAGGCCCTGCCCCCTCGC | 44 |
| 6629 | linker | GGGGS | 18 |
| 6635 | linker | GGTGGCGGAGGTTCTGGAGGTGGAGGTTCC | 50 |
| 6652 | PD-1 extracellular domain (aa) | Pgwfldspdrpwnpptfspallvvtegdnatftcsfsntsesfvlnwyrmspsnqtdkla afpedrsqpgqdcrfrvtqlpngrdfhmsvvrarrndsgtylcgaislapkaqikeslrael rvterraevptahpspsprpagqfqtlv | |
| 6653 | PD-1 extracellular domain (na) | Cccggatggtttctggactctccggatcgcccgtggaatcccccaaccttctcaccggcact cttggttgtgactgagggcgataatgcgaccttcacgtgctcgttctccaacacctccgaatca ttcgtgctgaactggtaccgcatgagcccgtcaaaccagaccgacaagctcgccgcgtttcc ggaagatcggtcgcaaccgggacaggattgtcggttccgcgtgactcaactgccgaatgg | |

TABLE 7-continued

Exemplary sequences of various components of CAR (aa-amino acids, na-nucleic acids that encodes the corresponding protein)

| SEQ ID NO | description | Sequence | Corresp. To huCD19 |
|---|---|---|---|
| | | cagagacttccacatgagcgtggtccgcgctaggcgaaacgactccgggacctacctgtg<br>ggagccatctcgctggcgcctaagggcccaaatcaaagagagcttgagggccgaactgaga<br>gtgaccgagcgcagagctgaggtgccaactgcacatccatcccatcgcctcggcctgcg<br>gggcagtttcagaccctggtc | |
| 6654 | PD-1 CAR (aa) with signal | Malpvtalllplalllhaarppgwfldspdrpwnpptfspallvvtegdnatftcsfsntses<br>fvlnwyrmspsnqtdklaafpedrsqpgqdcrfrvtqlpngrdfhmsvvrarrndsgtyl<br>cgaislapkaqikeslraelrvterraevptahpspsprpagqfqtlvttttpaprpptpaptia<br>sqplslrpeacrpaaggavhtrgldfacdiyiwaplagtcgvlllslvitlyckrgrkkllyif<br>kqpfmrpvqttqeedgcscrfpeeeeggcelrvkfsrsadapaykqgqnqlynelnlgrr<br>eeydvldkrrgrdpemggkprrknpqeglynelqkdkmaeayseigmkgerrrgkg<br>hdglyqglstatkdtydalhmqalppr | |
| 6655 | PD-1 CAR (na) | Atggccctccctgtcactgccctgcttctcccctcgcactcctgctccacgccgctagacc<br>acccggatggtttctggactctccggatcgcccgtggaatcccccaaccttctcaccggcact<br>cttggttgtgactgagggcgataatgcgaccttcacgtgctcgttctccaacacctccgaatca<br>ttcgtgctgaactggtaccgcatgagcccgtcaaaccagaccgacaagctcgccgcgtttcc<br>ggaagatcggtcgcaaccgggacaggattgtcggttccgcgtgactcaactgccgaatgg<br>cagagacttccacatgagcgtggtccgcgctaggcgaaacgactccgggacctacctgtgc<br>ggagccatctcgctggcgcctaagggcccaaatcaaagagagcttgagggccgaactgaga<br>gtgaccgagcgcagagctgaggtgccaactgcacatccatcccatcgcctcggcctgcg<br>gggcagtttcagaccctggtcaccgaccactccggcgccgcgccaccgactccggcccca<br>actatcgcgagccagcccctgtcgctgaggccggaagcatgccgccctgccgccggaggt<br>gctgtgcatacccggggattggacttcgcatgcgacatctacatttgggctcctctcgccgga<br>acttgtggcgtgctccttctgtccctggtcatcaccctgtactgcaagcggggtcggaaaaag<br>cttctgtacattttcaagcagcccttcatgaggcccgtgcaaaccacccaggaggaggacgg<br>ttgctcctgccggttccccgaagaggaagaaggaggttgcgagctgcgcgtgaagttctcc<br>cggagcgccgacgccccgcctataagcagggccagaaccagctgtacaacgaactgaa<br>cctgggacggcgggaagagtacgatgtgctggacaagcggcgcggccgggaccccgaa<br>atgggcgggaagcctagaagaaagaaccctcaggaaggcctgtataacgagctgcagaa<br>ggacaagatggccgaggcctactccgaaattgggatgaagggagagcggcggagggga<br>aaggggcacgacggcctgtaccaaggactgtccaccgccaccaaggacacatacgatgc<br>cctgcacatgcaggcccttccccctcgc | |
| 6592 | linker | (Gly-Gly-Gly-Ser)n, where n = 1-10 | 105 |
| 6593 | linker | (Gly4 Ser)4 | 106 |
| 6594 | linker | (Gly4 Ser)3 | 107 |
| 6595 | linker | (Gly3 Ser) | 108 |
| 6656 | PD1 CAR (aa) | Pgwfldspdrpwnpptfspallvvtegdnatftcsfsntsesfvlnwyrmspsnqtdkla<br>afpedrsqpgqdcrfrvtqlpngrdfhmsvvrarrndsgtylcgaislapkaqikeslrael<br>rvterraevptahpspsprpagqfqtlvttttpaprpptpaptiasqplslrpeacrpaaggav<br>htrgldfacdiyiwaplagtcgvlllslvitlyckrgrkkllyifkqpfmrpvqttqeedgcs<br>crfpeeeeggcelrvkfsrsadapaykqgqnqlynelnlgrreeydvldkrrgrdpemg<br>gkprrknpqeglynelqkdkmaeayseigmkgerrrgkghdglyqglstatkdtydal<br>hmqalppr | |

VI. Cells

In another aspect, the invention provides cells which comprise, or which at any time comprised, a gRNA molecule, e.g., one or more gRNA molecules, as described herein, or a CRISPR system as described herein. In an embodiment, the cell has been altered, e.g., the target sequence targeted by the gRNA molecule has been altered, e.g., to create an indel, by introduction of a gRNA molecule as described herein (or nucleic acid encoding said gRNA molecule), or a CRISPR system (or nucleic acid encoding one or more components of said CRISPR system) as described herein, e.g., altered by a method described herein. In an embodiment, the alteration results in reduced or no expression of the functional (e.g., wild type) gene product of the gene comprising the target site.

In one aspect, the cell is an animal cell. In embodiments, the cell is a mammalian, primate, or human cell. In embodiments, the cell is a human cell. In embodiments, the cell is an immune effector cell (e.g., a population of immune effector cells), for example a T cell or NK cell. In embodiments, the T cell (e.g., population of T cells) is or comprises a CD4+ T cell, a CD8+ T cell, or a combination thereof. In embodiments, the cell is autologous. In embodiments, the cell is allogeneic.

In a preferred embodiment the cell (e.g., the population of cells) has been, or will be, engineered to express a chimeric antigen receptor (CAR), e.g., a CAR as described in Section V. In embodiments, the cell is engineered to express a BCMA CAR, e.g., as described herein. In embodiments, the CAR-engineered cell is allogeneic. In embodiments, the CAR-engineered cell is autologous.

In another aspect, the invention provides cells, such as those described above, which include, has at any time included, or will include a second gRNA molecule as described herein, e.g., a second gRNA molecule with a targeting domain different from that of the first gRNA molecule. In embodiments, the two gRNA molecules are complementary to target sites within the same gene, for example, are complementary to two target sites within the gene for the same allogeneic T cell target, e.g., comprise two target sites within the TRAC gene. Such cells may comprise a large, e.g., 20-60, 20-70, 20-80, 20-90, 20-100, or greater than 1000, greater than 2000, greater than 3000, greater than 4000, greater than 5000, greater than 6000 base pair excision of DNA located between the target sites of the two gRNA molecules, as described herein in Section VIII. Alternatively, the two gRNAs targeting target sequences of the same gene may not lead to an excision, but may instead, for example, create an indel at or near each of the targeted sites. In other embodiments, the two or more gRNA molecules are complementary to target sites within two different genes whose gene products associate to form a molecular complex. An example of such an embodiment is a first gRNA molecule targeting TRAC, and a second gRNA molecule targeting TRBC1 (wherein both the TCR alpha constant chain and the TCR beta constant chain 1 are components of the TCR on the cell surface). Without being bound by theory, introducing CRISPR systems which target two or more target sequences of the same gene, or which target two or more genes of the same molecular complex (e.g., in the case of targeting TRAC and TRBC1) may lead to further reduced or eliminated expression of the target gene product, relative to introducing a CRISPR system which targets only a single target sequence of the target gene.

It will be understood that in any of the aspects and embodiments of the invention in which two or more target sites of different genes (or different molecular complexes, e.g., when targeting TCR, and B2M) are targeted, that for any or all of the different gene (or molecular complex) targets, two or more gRNAs may be employed with respect to one or more of said different genes or different molecular complexes. For example, in embodiments and aspects in which expression of TCR and expression of B2M is reduced or eliminated, the reduced or eliminated expression of TCR may be accomplished by, for example, one gRNA targeting TRAC, by more than one gRNA molecule targeting TRAC, or by one gRNA molecule targeting TRAC and a second gRNA targeting a different component of the TCR, e.g., TRBC1; while at the same time, or alternatively, targeting of B2M may be accomplished by, for example, one gRNA molecule targeting B2M or by two or more gRNA molecules targeting B2M.

In other embodiments, the two or more, e.g. two, gRNA molecules are complementary to target sites within different genes. Such cells may comprise alterations, e.g., indels, at or near each target site such that expression of the functional gene product of more than one gene is reduced or eliminated. As discussed above, in such embodiments, more than one gRNA molecule targeted to each of the different genes may be employed.

In embodiments, the cell comprises, has comprised or will comprise a first gRNA molecule comprising a targeting domain complementary with a target sequence of an allogeneic T-cell target (e.g., a targeting domain described in Tables 1, 3, 4 or 5), and a second gRNA molecule comprising a targeting domain complementary with a target sequence of an inhibitory molecule or downstream effector of signaling through an inhibitory molecule (e.g., comprises a targeting domain described in Table 2 or Table 6). In embodiments, the inhibitory molecule or downstream effector of signaling through an inhibitory molecule is CD274, HAVCR2, LAGS, PDCD1, PD-L2, CTLA4, CEACAM (e.g., CEACAM-1, CEACAM-3 and/or CEACAM-5), VISTA, BTLA, TIGIT, LAIR1, CD160, 2B4, CD80, CD86, B7-H3 (CD113), B7-H4 (VTCN1), HVEM (TNERSF14 or CD107), KIR, A2aR, MHC class I, MHC class II, GAL9, adenosine, and TGF beta, or PTPN11.

In embodiments, the cell comprises, has comprised or will comprise a first gRNA molecule comprising a targeting domain complementary with a target sequence of TRAC, TRBC1, TRBC2, CD247, CD3D, CD3E, or CD3G, and a second gRNA molecule comprising a targeting domain complementary with a target sequence of B2M, NLRC5, HLA-A, HLA-B or HLA-C.

In embodiments, a cell of the invention comprises, has comprised or will comprise a first gRNA molecule comprising a targeting domain complementary with a target sequence of TRAC, TRBC1, TRBC2, CD247, CD3D, CD3E, or CD3G; a second gRNA molecule comprising a targeting domain complementary with a target sequence of B2M, NLRC5, HLA-A, HLA-B or HLA-C; and a third gRNA molecule comprising a targeting domain complementary with a target sequence of CIITA. Without being bound by theory, it is believed that reducing or eliminating expression of a MHC class I molecule, e.g., by a method described herein employing a gRNA to B2M or a gRNA to NLRC5, may cause the modified cell to upregulate expression of one or more MHC class II molecules. In such circumstances, in order to create, for example, an allogeneic cell (e.g., an allogeneic T cell, e.g., a CAR-expressing allogeneic T cell described herein) able to avoid a host versus graft disease response, it may be beneficial to reduce or eliminate expression of one or more MHC class II molecules (in addition to the one or more MHC class I molecules), for example, by a method described herein employing a gRNA to CIITA. In one embodiment, the cell, e.g., a CAR-expressing cell, e.g., as described herein, comprises, has comprised or will comprise, a first gRNA to TRAC, e.g., as described herein, a second gRNA to B2M, e.g., as described herein, and a third gRNA to CIITA, e.g., as described herein. In one embodiment, the cell, e.g., a CAR-expressing cell, e.g., as described herein, comprises, has comprised or will comprise, a first gRNA to TRAC, e.g., as described herein, a second gRNA to NLRC5, e.g., as described herein, and a third gRNA to CIITA, e.g., as described herein.

In embodiments, the invention provides a cell, e.g., a CAR-expressing cell, e.g., as described herein, that comprises one or more modifications (e.g., nucleotide insertions or deletions) to an endogenous gene encoding a component of the TCR, e.g., TRAC or TRBC (e.g., TRBC1 or TRBC2); one or more modifications (e.g., nucleotide insertions or deletions) to an endogenous B2M gene; and/or one or more modifications (e.g., nucleotide insertions or deletions) to an endogenous CIITA gene. In embodiments, said modifications reduce or eliminate expression of said gene. In embodiments, the invention provides a cell, e.g., a CAR-expressing cell, e.g., as described herein, that is TCR– (e.g., has a level of expression of TCR greater than 50%, 60%, 70%, 80%, 90%, 95%, 96%, 97%, 98%, or 99% lower than that of an unmodified cell of the same type, as detected by FACS, e.g., FACS using an anti-CD3 antibody), B2M– (e.g., has a level of expression of B2M and/or one or more MHC class I proteins greater than 50%, 60%, 70%, 80%, 90%, 95%, 96%, 97%, 98%, or 99% lower than that of an unmodified cell of the same type, as detected by FACS, e.g., FACS using an anti-B2M antibody) and/or CIITA– (e.g., has a level of expression of CIITA and/or a MHC class II protein greater than 50%, 60%, 70%, 80%, 90%, 95%, 96%, 97%, 98%, or 99% lower than that of an unmodified cell of the same type, as detected by FACS, e.g., FACS using an anti-CIITA antibody). In an embodiment, the cell is engineered to express a CAR molecule, e.g., as described herein. In embodiments, the CAR is a CD19 CAR, e.g., as described herein. In other embodiments, the CAR is a BCMA CAR, e.g., as described herein. In other embodiments, the CAR is a CD123 CAR, e.g., as described herein.

In embodiments, the invention provides a cell, e.g., a CAR-expressing cell, e.g., as described herein, that comprises one or more modifications (e.g., nucleotide insertions or deletions) to an endogenous gene encoding a component of the TCR, e.g., TRAC or TRBC (e.g., TRBC1 or TRBC2); one or more modifications (e.g., nucleotide insertions or deletions) to an endogenous NLRC5 gene; and/or one or more modifications (e.g., nucleotide insertions or deletions) to an endogenous CIITA gene. In embodiments, said modifications reduce or eliminate expression of said gene. In embodiments, the invention provides a cell, e.g., a CAR-expressing cell, e.g., as described herein, that is TCR− (e.g., has a level of expression of TCR greater than 50%, 60%, 70%, 80%, 90%, 95%, 96%, 97%, 98%, or 99% lower than that of an unmodified cell of the same type, as detected by FACS, e.g., FACS using an anti-CD3 antibody), NLRC5− (e.g., has a level of expression of NLRC5 and/or one or more MHC class I proteins greater than 50%, 60%, 70%, 80%, 90%, 95%, 96%, 97%, 98%, or 99% lower than that of an unmodified cell of the same type, as detected by FACS, e.g., FACS using an anti-NLRC5 antibody) and/or CIITA− (e.g., has a level of expression of CIITA and/or a MHC class II protein greater than 50%, 60%, 70%, 80%, 90%, 95%, 96%, 97%, 98%, or 99% lower than that of an unmodified cell of the same type, as detected by FACS, e.g., FACS using an anti-CIITA antibody). In an embodiment, the cell is engineered to express a CAR molecule, e.g., as described herein. In embodiments, the CAR is a CD19 CAR, e.g., as described herein. In other embodiments, the CAR is a BCMA CAR, e.g., as described herein. In other embodiments, the CAR is a CD123 CAR, e.g., as described herein.

In embodiments, the cell comprises, has comprised or will comprise a first gRNA molecule comprising a targeting domain complementary with a target sequence of TRAC, TRBC1, TRBC2, CD247, CD3D, CD3E, or CD3G, and a second gRNA molecule comprises a targeting domain complementary with a target sequence of NR3C1, DCK, CD52 or FKBP1A.

In embodiments, the cell comprises, has comprised or will comprise a first gRNA molecule and a second gRNA molecule, wherein: (1) the first gRNA molecule comprises a targeting domain selected from the group consisting of SEQ ID NO: 5528 to SEQ ID NO: 5623 or SEQ ID NO: 5816 to SEQ ID NO: 5965, and the second guide RNA molecule comprises a targeting domain selected from the group consisting of SEQ ID NO: 1 to SEQ ID NO: 83 and SEQ ID NO: 5492 to SEQ ID NO: 5527; (2) the first gRNA molecule comprises a targeting domain selected from the group consisting of SEQ ID NO: 5528 to SEQ ID NO: 5623 or SEQ ID NO: 5816 to SEQ ID NO: 5965, and the second guide RNA molecule comprises a targeting domain selected from the group consisting of SEQ ID NO: 969 to SEQ ID NO: 1345; (3) the first gRNA molecule comprises a targeting domain selected from the group consisting of SEQ ID NO: 5528 to SEQ ID NO: 5623 or SEQ ID NO: 5816 to SEQ ID NO: 5965, and the second guide RNA molecule comprises a targeting domain selected from the group consisting of SEQ ID NO: 1346 to SEQ ID NO: 1698; (4) the first gRNA molecule comprises a targeting domain selected from the group consisting of SEQ ID NO: 5528 to SEQ ID NO: 5623 or SEQ ID NO: 5816 to SEQ ID NO: 5965, and the second guide RNA molecule comprises a targeting domain selected from the group consisting of SEQ ID NO: 1699 to SEQ ID NO: 2068; (5) the first gRNA molecule comprises a targeting domain selected from the group consisting of SEQ ID NO: 5528 to SEQ ID NO: 5623 or SEQ ID NO: 5816 to SEQ ID NO: 5965, and the second guide RNA molecule comprises a targeting domain selected from the group consisting of SEQ ID NO: 2069 to SEQ ID NO: 2941; (6) the first gRNA molecule comprises a targeting domain selected from the group consisting of SEQ ID NO: 5528 to SEQ ID NO: 5623 or SEQ ID NO: 5816 to SEQ ID NO: 5965, and the second guide RNA molecule comprises a targeting domain selected from the group consisting of SEQ ID NO: 5278 to SEQ ID NO: 5491; (7) the first gRNA molecule comprises a targeting domain selected from the group consisting of SEQ ID NO: 5528 to SEQ ID NO: 5623 or SEQ ID NO: 5816 to SEQ ID NO: 5965, and the second guide RNA molecule comprises a targeting domain selected from the group consisting of SEQ ID NO: 6227 to SEQ ID NO: 6324; (8) the first gRNA molecule comprises a targeting domain selected from the group consisting of SEQ ID NO: 5528 to SEQ ID NO: 5623 or SEQ ID NO: 5816 to SEQ ID NO: 5965, and the second guide RNA molecule comprises a targeting domain selected from the group consisting of SEQ ID NO: 6325 to SEQ ID NO: 6583; (9) the first gRNA molecule comprises a targeting domain selected from the group consisting of SEQ ID NO: 5624 to SEQ ID NO: 5643 or SEQ ID NO: 5966 to SEQ ID NO: 6097, and the second guide RNA molecule comprises a targeting domain selected from the group consisting of SEQ ID NO: 1 to SEQ ID NO: 83 and SEQ ID NO: 5492 to SEQ ID NO: 5527; (10) the first gRNA molecule comprises a targeting domain selected from the group consisting of SEQ ID NO: 5624 to SEQ ID NO: 5643 or SEQ ID NO: 5966 to SEQ ID NO: 6097, and the second guide RNA molecule comprises a targeting domain selected from the group consisting of SEQ ID NO: 969 to SEQ ID NO: 1345; (11) the first gRNA molecule comprises a targeting domain selected from the group consisting of SEQ ID NO: 5624 to SEQ ID NO: 5643 or SEQ ID NO: 5966 to SEQ ID NO: 6097, and the second guide RNA molecule comprises a targeting domain selected from the group consisting of SEQ ID NO: 1346 to SEQ ID NO: 1698; (12) the first gRNA molecule comprises a targeting domain selected from the group consisting of SEQ ID NO: 5624 to SEQ ID NO: 5643 or SEQ ID NO: 5966 to SEQ ID NO: 6097, and the second guide RNA molecule comprises a targeting domain selected from the group consisting of SEQ ID NO: 1699 to SEQ ID NO: 2068; (13) the first gRNA molecule comprises a targeting domain selected from the group consisting of SEQ ID NO: 5624 to SEQ ID NO: 5643 or SEQ ID NO: 5966 to SEQ ID NO: 6097, and the second guide RNA molecule comprises a targeting domain selected from the group consisting of SEQ ID NO: 2069 to SEQ ID NO: 2941; (14) the first gRNA molecule comprises a targeting domain selected from the group consisting of SEQ ID NO: 5624 to SEQ ID NO: 5643 or SEQ ID NO: 5966 to SEQ ID NO: 6097, and the second guide RNA molecule comprises a targeting domain selected from the group consisting of SEQ ID NO: 5278 to SEQ ID NO: 5491; (15) the first gRNA molecule comprises a targeting domain selected from the group consisting of SEQ ID NO: 5624 to SEQ ID NO: 5643 or SEQ ID NO: 5966 to SEQ ID NO: 6097, and the second guide RNA molecule comprises a targeting domain selected from the group consisting of SEQ ID NO: 6227 to SEQ ID NO: 6324; (16) the first gRNA molecule comprises a targeting domain selected from the group consisting of SEQ ID NO: 5624 to SEQ ID NO: 5643 or SEQ ID NO: 5966 to SEQ ID NO: 6097, and the second guide RNA molecule comprises a targeting domain selected from the group consisting of SEQ ID NO: 6325 to SEQ ID NO: 6583; (17) the first gRNA molecule comprises a targeting domain selected from the group consisting of SEQ ID NO: 5644 to SEQ ID NO: 5719 or SEQ ID NO: 6098 to SEQ ID NO: 6226, and the second guide RNA molecule comprises a targeting domain selected from the group consisting of SEQ ID NO: 1 to SEQ ID NO: 83 and SEQ ID NO: 5492 to SEQ ID NO: 5527; (18) the first gRNA molecule comprises a targeting domain selected from the group consisting of SEQ ID NO: 5644 to SEQ ID NO: 5719 or SEQ ID NO: 6098 to SEQ ID NO: 6226, and the second guide RNA molecule comprises a targeting domain selected from the group consisting of SEQ ID NO: 969 to SEQ ID NO: 1345; (19) the first gRNA molecule comprises a targeting domain selected from the group consisting of SEQ ID NO: 5644 to SEQ ID NO: 5719 or SEQ ID NO: 6098 to SEQ ID NO: 6226, and the second guide RNA molecule comprises a targeting domain selected from the group consisting of SEQ ID NO: 1346 to SEQ ID NO: 1698; (20) the first gRNA molecule comprises a targeting domain selected from the group consisting of SEQ ID NO: NO: 5644 to SEQ ID NO: NO: 5719 or SEQ ID NO: 6098 to SEQ ID NO: 6226, and the second guide RNA molecule comprises a targeting domain selected from the group consisting of SEQ ID NO: 1699 to SEQ ID NO: 2068; (21) the first gRNA molecule comprises a targeting domain selected from the group consisting of SEQ ID NO: 5644 to SEQ ID NO: 5719 or SEQ ID NO: 6098 to SEQ ID NO: 6226, and the second guide RNA molecule comprises a targeting domain selected from the group consisting of SEQ ID NO: 2069 to SEQ ID NO: 2941; (22) the first gRNA molecule comprises a targeting domain selected from the group consisting of SEQ ID NO: 5644 to SEQ ID NO: 5719 or SEQ ID NO: 6098 to SEQ ID NO: 6226, and the second guide RNA molecule comprises a targeting domain selected from the group consisting of SEQ ID NO: 5278 to SEQ ID NO: 5491; (23) the first gRNA molecule comprises a targeting domain selected from the group consisting of SEQ ID NO: 5644 to SEQ ID NO: 5719 or SEQ ID NO: 6098 to SEQ ID NO: 6226, and the second guide RNA molecule comprises a targeting domain selected from the group consisting of SEQ ID NO: 6227 to SEQ ID NO: 6324; (24) the first gRNA molecule comprises a targeting domain selected from the group consisting of SEQ ID NO: 5644 to SEQ ID NO: 5719 or SEQ ID NO: 6098 to SEQ ID NO: 6226, and the second guide RNA molecule comprises a targeting domain selected from the group consisting of SEQ ID NO: 6325 to SEQ ID NO: 6583; (25) the first gRNA molecule comprises a targeting domain selected from the group consisting of SEQ ID NO: 84 to SEQ ID NO: 392, and the second guide RNA molecule comprises a targeting domain selected from the group consisting of SEQ ID NO: 1 to SEQ ID NO: 83 and SEQ ID NO: 5492 to SEQ ID NO: 5527; (26) the first gRNA molecule comprises a targeting domain selected from the group consisting of SEQ ID NO: 84 to SEQ ID NO: 392, and the second guide RNA molecule comprises a targeting domain selected from the group consisting of SEQ ID NO: 969 to SEQ ID NO: 1345; (27) the first gRNA molecule comprises a targeting domain selected from the group consisting of SEQ ID NO: 84 to SEQ ID NO: 392, and the second guide RNA molecule comprises a targeting domain selected from the group consisting of SEQ ID NO: 1346 to SEQ ID NO: 1698; (28) the first gRNA molecule comprises a targeting domain selected from the group consisting of SEQ ID NO: 84 to SEQ ID NO: 392, and the second guide RNA molecule comprises a targeting domain selected from the group consisting of SEQ ID NO: 1699 to SEQ ID NO: 2068; (29) the first gRNA molecule comprises a targeting domain selected from the group consisting of SEQ ID NO: 84 to SEQ ID NO: 392, and the second guide RNA molecule comprises a targeting domain selected from the group consisting of SEQ ID NO: 2069 to SEQ ID NO: 2941; (30) the first gRNA molecule comprises a targeting domain selected from the group consisting of SEQ ID NO: 84 to SEQ ID NO: 392, and the second guide RNA molecule comprises a targeting domain selected from the group consisting of SEQ ID NO: 5278 to SEQ ID NO: 5491; (31) the first gRNA molecule comprises a targeting domain selected from the group consisting of SEQ ID NO: 84 to SEQ ID NO: 392, and the second guide RNA molecule comprises a targeting domain selected from the group consisting of SEQ ID NO: 6227 to SEQ ID NO: 6324; (32) the first gRNA molecule comprises a targeting domain selected from the group consisting of SEQ ID NO: 84 to SEQ ID NO: 392, and the second guide RNA molecule comprises a targeting domain selected from the group consisting of SEQ ID NO: 6325 to SEQ ID NO: 6583; (33) the first gRNA molecule comprises a targeting domain selected from the group consisting of SEQ ID NO: 393 to SEQ ID NO: 532, and the second guide RNA molecule comprises a targeting domain selected from the group consisting of SEQ ID NO: 1 to SEQ ID NO: 83 and SEQ ID NO: 5492 to SEQ ID NO: 5527; (34) the first gRNA molecule comprises a targeting domain selected from the group consisting of SEQ ID NO: 393 to SEQ ID NO: 532, and the second guide RNA molecule comprises a targeting domain selected from the group consisting of SEQ ID NO: 969 to SEQ ID NO: 1345; (35) the first gRNA molecule comprises a targeting domain selected from the group consisting of SEQ ID NO: 393 to SEQ ID NO: 532, and the second guide RNA molecule comprises a targeting domain selected from the group consisting of SEQ ID NO: 1346 to SEQ ID NO: 1698; (36) the first gRNA molecule comprises a targeting domain selected from the group consisting of SEQ ID NO: 393 to SEQ ID NO: 532, and the second guide RNA molecule comprises a targeting domain selected from the group consisting of SEQ ID NO: 1699 to SEQ ID NO: 2068; (37) the first gRNA molecule comprises a targeting domain selected from the group consisting of SEQ ID NO: 393 to SEQ ID NO: 532, and the second guide RNA molecule comprises a targeting domain selected from the group consisting of SEQ ID NO: 2069 to SEQ ID NO: 2941; (38) the first gRNA molecule comprises a targeting domain selected from the group consisting of SEQ ID NO: 393 to SEQ ID NO: 532, and the second guide RNA molecule comprises a targeting domain selected from the group consisting of SEQ ID NO: 5278 to SEQ ID NO: 5491; (39) the first gRNA molecule comprises a targeting domain selected from the group consisting of SEQ ID NO: 393 to SEQ ID NO: 532, and the second guide RNA molecule comprises a targeting domain selected from the group consisting of SEQ ID NO: 6227 to SEQ ID NO: 6324; (40) the first gRNA molecule comprises a targeting domain selected from the group consisting of SEQ ID NO: 393 to SEQ ID NO: 532, and the second guide RNA molecule comprises a targeting domain selected from the group consisting of SEQ ID NO: 6325 to SEQ ID NO: 6583; (41) the first gRNA molecule comprises a targeting domain selected from the group consisting of SEQ ID NO: 533 to SEQ ID NO: 839, and the second guide RNA molecule comprises a targeting domain selected from the group consisting of SEQ ID NO: 1 to SEQ ID NO: 83 and SEQ ID NO: 5492 to SEQ ID NO: 5527; (42) the first gRNA molecule comprises a targeting domain selected from the group consisting of SEQ ID NO: 533 to SEQ ID NO: 839, and the second guide RNA molecule comprises a targeting domain selected from the group consisting of SEQ ID NO: 969 to SEQ ID NO: 1345; (43) the first gRNA molecule comprises a targeting domain selected from the group consisting of SEQ ID NO: 533 to SEQ ID NO: 839, and the second guide RNA molecule comprises a targeting domain selected from the group consisting of SEQ ID NO: 1346 to SEQ ID NO: 1698; (44) the first gRNA molecule comprises a targeting domain selected from the group consisting of SEQ ID NO: 533 to SEQ ID NO: 839, and the second guide RNA molecule comprises a targeting domain selected from the group consisting of SEQ ID NO: 1699 to SEQ ID NO: 2068; (45) the first gRNA molecule comprises a targeting domain selected from the group consisting of SEQ ID NO: 533 to SEQ ID NO: 839, and the second guide RNA molecule comprises a targeting domain selected from the group consisting of SEQ ID NO: 2069 to SEQ ID NO: 2941; (46) the first gRNA molecule comprises a targeting domain selected from the group consisting of SEQ ID NO: 533 to SEQ ID NO: 839, and the second guide RNA molecule comprises a targeting domain selected from the group consisting of SEQ ID NO: 5278 to SEQ ID NO: 5491; (47) the first gRNA molecule comprises a targeting domain selected from the group consisting of SEQ ID NO: 533 to SEQ ID NO: 839, and the second guide RNA molecule comprises a targeting domain selected from the group consisting of SEQ ID NO: 6227 to SEQ ID NO: 6324; (48) the first gRNA molecule comprises a targeting domain selected from the group consisting of SEQ ID NO: 533 to SEQ ID NO: 839, and the second guide RNA molecule comprises a targeting domain selected from the group consisting of SEQ ID NO: 6325 to SEQ ID NO: 6583; (49) the first gRNA molecule comprises a targeting domain selected from the group consisting of SEQ ID NO: 840 to SEQ ID NO: 968, and the second guide RNA molecule comprises a targeting domain selected from the group consisting of SEQ ID NO: 1 to SEQ ID NO: 83 and SEQ ID NO: 5492 to SEQ ID NO: 5527; (50) the first gRNA molecule comprises a targeting domain selected from the group consisting of SEQ ID NO: 840 to SEQ ID NO: 968, and the second guide RNA molecule comprises a targeting domain selected from the group consisting of SEQ ID NO: 969 to SEQ ID NO: 1345; (51) the first gRNA molecule comprises a targeting domain selected from the group consisting of SEQ ID NO: 840 to SEQ ID NO: 968, and the second guide RNA molecule comprises a targeting domain selected from the group consisting of SEQ ID NO: 1346 to SEQ ID NO: 1698; (52) the first gRNA molecule comprises a targeting domain selected from the group consisting of SEQ ID NO: 840 to SEQ ID NO: 968, and the second guide RNA molecule comprises a targeting domain selected from the group consisting of SEQ ID NO: 1699 to SEQ ID NO: 2068; (53) the first gRNA molecule comprises a targeting domain selected from the group consisting of SEQ ID NO: 840 to SEQ ID NO: 968, and the second guide RNA molecule comprises a targeting domain selected from the group consisting of SEQ ID NO: 2069 to SEQ ID NO: 2941; (54) the first gRNA molecule comprises a targeting domain selected from the group consisting of SEQ ID NO: 840 to SEQ ID NO: 968, and the second guide RNA molecule comprises a targeting domain selected from the group consisting of SEQ ID NO: 5278 to SEQ ID NO: 5491; (55) the first gRNA molecule comprises a targeting domain selected from the group consisting of SEQ ID NO: 840 to SEQ ID NO: 968, and the second guide RNA molecule comprises a targeting domain selected from the group consisting of SEQ ID NO: 6227 to SEQ ID NO: 6324; (55) the first gRNA molecule comprises a targeting domain selected from the group consisting of SEQ ID NO: 840 to SEQ ID NO: 968, and the second guide RNA molecule comprises a targeting domain selected from the group consisting of SEQ ID NO: 6325 to SEQ ID NO: 6583; (56) the first gRNA molecule comprises a targeting domain selected from the group consisting of SEQ ID NO: 5528 to SEQ ID NO: 5623 or SEQ ID NO: 5816 to SEQ ID NO: 5965, and the second guide RNA molecule comprises a targeting domain selected from the group consisting of SEQ ID NO: 2942 to SEQ ID NO: 3270; (57) the first gRNA molecule comprises a targeting domain selected from the group consisting of SEQ ID NO: 5528 to SEQ ID NO: 5623 or SEQ ID NO: 5816 to SEQ ID NO: 5965, and the second guide RNA molecule comprises a targeting domain selected from the group consisting of SEQ ID NO: 3271 to SEQ ID NO: 3541; (58) the first gRNA molecule comprises a targeting domain selected from the group consisting of SEQ ID NO: 5528 to SEQ ID NO: 5623 or SEQ ID NO: 5816 to SEQ ID NO: 5965, and the second guide RNA molecule comprises a targeting domain selected from the group consisting of SEQ ID NO: 3542 to SEQ ID NO: 4032; (59) the first gRNA molecule comprises a targeting domain selected from the group consisting of SEQ ID NO: 5528 to SEQ ID NO: 5623 or SEQ ID NO: 5816 to SEQ ID NO: 5965, and the second guide RNA molecule comprises a targeting domain selected from the group consisting of SEQ ID NO: 4033 to SEQ ID NO: 4589 and SEQ ID NO: 5720 to SEQ ID NO: 5815; (60) the first gRNA molecule comprises a targeting domain selected from the group consisting of SEQ ID NO: 5528 to SEQ ID NO: 5623 or SEQ ID NO: 5816 to SEQ ID NO: 5965, and the second guide RNA molecule comprises a targeting domain selected from the group consisting of SEQ ID NO: 4590 to SEQ ID NO: 5277; (61) the first gRNA molecule comprises a targeting domain selected from the group consisting of SEQ ID NO: 5624 to SEQ ID NO: 5643 or SEQ ID NO: 5966 to SEQ ID NO: 6097, and the second guide RNA molecule comprises a targeting domain selected from the group consisting of SEQ ID NO: 2942 to SEQ ID NO: 3270; (62) the first gRNA molecule comprises a targeting domain selected from the group consisting of SEQ ID NO: 5624 to SEQ ID NO: 5643 or SEQ ID NO: 5966 to SEQ ID NO: 6097, and the second guide RNA molecule comprises a targeting domain selected from the group consisting of SEQ ID NO: 3271 to SEQ ID NO: 3541; (63) the first gRNA molecule comprises a targeting domain selected from the group consisting of SEQ ID NO: 5624 to SEQ ID NO: 5643 or SEQ ID NO: 5966 to SEQ ID NO: 6097, and the second guide RNA molecule comprises a targeting domain selected from the group consisting of SEQ ID NO: 3542 to SEQ ID NO: 4032; (64) the first gRNA molecule comprises a targeting domain selected from the group consisting of SEQ ID NO: 5624 to SEQ ID NO: 5643 or SEQ ID NO: 5966 to SEQ ID NO: 6097, and the second guide RNA molecule comprises a targeting domain selected from the group consisting of SEQ ID NO: 4033 to SEQ ID NO: 4589 and SEQ ID NO: 5720 to SEQ ID NO: 5815; (65) the first gRNA molecule comprises a targeting domain selected from the group consisting of SEQ ID NO: 5624 to SEQ ID NO: 5643 or SEQ ID NO: 5966 to SEQ ID NO: 6097, and the second guide RNA molecule comprises a targeting domain selected from the group consisting of SEQ ID NO: 4590 to SEQ ID NO: 5277; (66) the first gRNA molecule comprises a targeting domain selected from the group consisting of SEQ ID NO: 5644 to SEQ ID NO: 5719 or SEQ ID NO: 6098 to SEQ ID NO: 6226, and the second guide RNA molecule comprises a targeting domain selected from the group consisting of SEQ ID NO: 2942 to SEQ ID NO: 3270; (67) the first gRNA molecule comprises a targeting domain selected from the group consisting of SEQ ID NO: 5644 to SEQ ID NO: 5719 or SEQ ID NO: 6098 to SEQ ID NO: 6226, and the second guide RNA molecule comprises a targeting domain selected from the group consisting of SEQ ID NO: 3271 to SEQ ID NO: 3541; (68) the first gRNA molecule comprises a targeting domain selected from the group consisting of SEQ ID NO: 5644 to SEQ ID NO: 5719 or SEQ ID NO: 6098 to SEQ ID NO: 6226, and the second guide RNA molecule comprises a targeting domain selected from the group consisting of SEQ ID NO: 3542 to SEQ ID NO: 4032; (69) the first gRNA molecule comprises a targeting domain selected from the group consisting of SEQ ID NO: 5644 to SEQ ID NO: 5719 or SEQ ID NO: 6098 to SEQ ID NO: 6226, and the second guide RNA molecule comprises a targeting domain selected from the group consisting of SEQ ID NO: 4033 to SEQ ID NO: 4589 and SEQ ID NO: 5720 to SEQ ID NO: 5815; (70) the first gRNA molecule comprises a targeting domain selected from the group consisting of SEQ ID NO: 5644 to SEQ ID NO: 5719 or SEQ ID NO: 6098 to SEQ ID NO: 6226, and the second guide RNA molecule comprises a targeting domain selected from the group consisting of SEQ ID NO: 4590 to SEQ ID NO: 5277; (71) the first gRNA molecule comprises a targeting domain selected from the group consisting of SEQ ID NO: 84 to SEQ ID NO: 392, and the second guide RNA molecule comprises a targeting domain selected from the group consisting of SEQ ID NO: 2942 to SEQ ID NO: 3270; (72) the first gRNA molecule comprises a targeting domain selected from the group consisting of SEQ ID NO: 84 to SEQ ID NO: 392, and the second guide RNA molecule comprises a targeting domain selected from the group consisting of SEQ ID NO: 3271 to SEQ ID NO: 3541; (73) the first gRNA molecule comprises a targeting domain selected from the group consisting of SEQ ID NO: 84 to SEQ ID NO: 392, and the second guide RNA molecule comprises a targeting domain selected from the group consisting of SEQ ID NO: 3542 to SEQ ID NO: 4032; (74) the first gRNA molecule comprises a targeting domain selected from the group consisting of SEQ ID NO: 84 to SEQ ID NO: 392, and the second guide RNA molecule comprises a targeting domain selected from the group consisting of SEQ ID NO: 4033 to SEQ ID NO: 4589 and SEQ ID NO: 5720 to SEQ ID NO: 5815; (75) the first gRNA molecule comprises a targeting domain selected from the group consisting of SEQ ID NO: 84 to SEQ ID NO: 392, and the second guide RNA molecule comprises a targeting domain selected from the group consisting of SEQ ID NO: 4590 to SEQ ID NO: 5277; (76) the first gRNA molecule comprises a targeting domain selected from the group consisting of SEQ ID NO: 393 to SEQ ID NO: 532, and the second guide RNA molecule comprises a targeting domain selected from the group consisting of SEQ ID NO: 2942 to SEQ ID NO: 3270; (77) the first gRNA molecule comprises a targeting domain selected from the group consisting of SEQ ID NO: 393 to SEQ ID NO: 532, and the second guide RNA molecule comprises a targeting domain selected from the group consisting of SEQ ID NO: 3271 to SEQ ID NO: 3541; (78) the first gRNA molecule comprises a targeting domain selected from the group consisting of SEQ ID NO: 393 to SEQ ID NO: 532, and the second guide RNA molecule comprises a targeting domain selected from the group consisting of SEQ ID NO: 3542 to SEQ ID NO: 4032; (79) the first gRNA molecule comprises a targeting domain selected from the group consisting of SEQ ID NO: 393 to SEQ ID NO: 532, and the second guide RNA molecule comprises a targeting domain selected from the group consisting of SEQ ID NO: 4033 to SEQ ID NO: 4589 and SEQ ID NO: 5720 to SEQ ID NO: 5815; (80) the first gRNA molecule comprises a targeting domain selected from the group consisting of SEQ ID NO: 393 to SEQ ID NO: 532, and the second guide RNA molecule comprises a targeting domain selected from the group consisting of SEQ ID NO: 4590 to SEQ ID NO: 5277; (81) the first gRNA molecule comprises a targeting domain selected from the group consisting of SEQ ID NO: 533 to SEQ ID NO: 839, and the second guide RNA molecule comprises a targeting domain selected from the group consisting of SEQ ID NO: 2942 to SEQ ID NO: 3270; (82) the first gRNA molecule comprises a targeting domain selected from the group consisting of SEQ ID NO: 533 to SEQ ID NO: 839, and the second guide RNA molecule comprises a targeting domain selected from the group consisting of SEQ ID NO: 3271 to SEQ ID NO: 3541; (83) the first gRNA molecule comprises a targeting domain selected from the group consisting of SEQ ID NO: 533 to SEQ ID NO: 839, and the second guide RNA molecule comprises a targeting domain selected from the group consisting of SEQ ID NO: 3542 to SEQ ID NO: 4032; (85) the first gRNA molecule comprises a targeting domain selected from the group consisting of SEQ ID NO: 533 to SEQ ID NO: 839, and the second guide RNA molecule comprises a targeting domain selected from the group consisting of SEQ ID NO: 4033 to SEQ ID NO: 4589 and SEQ ID NO: 5720 to SEQ ID NO: 5815; (86) the first gRNA molecule comprises a targeting domain selected from the group consisting of SEQ ID NO: 533 to SEQ ID NO: 839, and the second guide RNA molecule comprises a targeting domain selected from the group consisting of SEQ ID NO: 4590 to SEQ ID NO: 5277; (87) the first gRNA molecule comprises a targeting domain selected from the group consisting of SEQ ID NO: 840 to SEQ ID NO: 968, and the second guide RNA molecule comprises a targeting domain selected from the group consisting of SEQ ID NO: 2942 to SEQ ID NO: 3270; (88) the first gRNA molecule comprises a targeting domain selected from the group consisting of SEQ ID NO: 840 to SEQ ID NO: 968, and the second guide RNA molecule comprises a targeting domain selected from the group consisting of SEQ ID NO: 3271 to SEQ ID NO: 3541; (89) the first gRNA molecule comprises a targeting domain selected from the group consisting of SEQ ID NO: 840 to SEQ ID NO: 968, and the second guide RNA molecule comprises a targeting domain selected from the group consisting of SEQ ID NO: 3542 to SEQ ID NO: 4032; (90) the first gRNA molecule comprises a targeting domain selected from the group consisting of SEQ ID NO: 840 to SEQ ID NO: 968, and the second guide RNA molecule comprises a targeting domain selected from the group consisting of SEQ ID NO: 4033 to SEQ ID NO: 4589 and SEQ ID NO: 5720 to SEQ ID NO: 5815; or (91) the first gRNA molecule comprises a targeting domain selected from the group consisting of SEQ ID NO: 840 to SEQ ID NO: 968, and the second guide RNA molecule comprises a targeting domain selected from the group consisting of SEQ ID NO: 4590 to SEQ ID NO: 5277.

In an embodiment, the cell comprises, has comprised or will comprise a first gRNA molecule comprising a targeting domain comprising, e.g., consisting of, SEQ ID NO: 5569 or 5586, and a second gRNA molecule comprising a targeting domain comprising, e.g., consisting of, SEQ ID NO: 5775. Said cell preferably comprises an alteration to both TRAC and PDCD1, such that expression of functional TCR and expression of functional PD-1 is reduced or eliminated. In an embodiment, the cell is an immune effector cell, e.g., a T cell or NK cell. In an embodiment, the cell is allogeneic. In an embodiment, the cell is autologous. In an embodiment, the cell is or will be further engineered to express a CAR as described herein.

In embodiments of the invention, a cell of the invention comprises, has comprised or will comprise a first gRNA molecule comprising a targeting domain complementary to a target sequence of a component of the T cell receptor (e.g., TRAC); a second gRNA molecule comprising a targeting domain complementary to a target sequence of B2M; and a third gRNA molecule comprising a targeting domain complementary to a target sequence of CIITA. Said cell preferably comprises a modification at or near the target sequence of said first gRNA, said second gRNA, and said third gRNA molecules, such that expression of functional TCR, expression of functional B2M and expression of functional CIITA is reduced or eliminated. In an embodiment, the cell is an immune effector cell, e.g., a T cell or NK cell. In an embodiment, the cell is allogeneic. In an embodiment, the cell is autologous. In an embodiment, the cell is or will be further engineered to express a CAR as described herein.

In an aspect, a cell of the invention comprises (e.g., a population of cells of the invention comprises one or more cells which comprise):
 (a) Nucleic acid sequence encoding a CAR, e.g., as described herein;
 (b) Nucleic acid sequence encoding an NK inhibitory molecule, e.g., as described herein, e.g., nucleic acid encoding an HLA-G or HLA-G:B2M fusion as described herein;
 (c) An indel at or near a sequence of a gene encoding a component of a TCR (e.g., TRAC, TRBC1 or TRBC2, e.g. TRAC) or its regulatory elements, e.g., an indel at or near a target sequence of a gRNA comprising a targeting domain to a component of a TCR (e.g., TRAC, TRBC1 or TRBC2, e.g. TRAC), e.g., comprising a targeting domain listed in Table 1, Table 4 or Table 5;
 (d) An indel at or near a sequence of the gene encoding B2M or its regulatory elements, e.g., an indel at or near a target sequence of a gRNA comprising a targeting domain to B2M, e.g., comprising a targeting domain listed in Table 1 or Table 3;
 (e) Optionally, an indel at or near a sequence of the gene encoding CIITA or its regulatory elements, e.g., an indel at or near a target sequence of a gRNA comprising a targeting domain to CIITA, e.g., comprising a targeting domain listed in Table 1 or Table 6c; and
 (f) Optionally, an indel at or near a sequence of the gene encoding LILRB1 or its regulatory elements, e.g., an indel at or near a target sequence of a gRNA comprising a targeting domain to LILRB1, e.g., comprising a targeting domain listed in Table 6d;

Wherein the cell (or population of cells comprises one or more cells which) expresses the CAR and the NK inhibitory molecule, and exhibits reduced or eliminated expression and/or function of one or more of: i) a component of a TCR (e.g., TRAC, TRBC1 or TRBC2, e.g. TRAC), ii) B2M, iii) CIITA, and/or iv) LILRB1. In embodiments the indels are In an aspect, a cell of the invention comprises (e.g., a population of cells of the invention comprises one or more cells which comprise):
 (a) Nucleic acid sequence encoding a CAR, e.g., as described herein;
 (b) Nucleic acid sequence encoding an NK inhibitory molecule, e.g., as described herein, e.g., nucleic acid encoding an HLA-G as described herein;
 (c) An indel at or near a sequence of a gene encoding a component of a TCR (e.g., TRAC, TRBC1 or TRBC2, e.g. TRAC) or its regulatory elements, e.g., an indel at or near a target sequence of a gRNA comprising a targeting domain to a component of a TCR (e.g., TRAC, TRBC1 or TRBC2, e.g. TRAC), e.g., comprising a targeting domain listed in Table 1, Table 4 or Table 5;
 (d) An indel at or near a sequence of the gene encoding NLRC5 or its regulatory elements, e.g., an indel at or near a target sequence of a gRNA comprising a targeting domain to NLRC5, e.g., comprising a targeting domain listed in Table 1;
 (e) Optionally, an indel at or near a sequence of the gene encoding CIITA or its regulatory elements, e.g., an indel at or near a target sequence of a gRNA comprising a targeting domain to CIITA, e.g., comprising a targeting domain listed in Table 1 or Table 6c; and
 (f) Optionally, an indel at or near a sequence of the gene encoding LILRB1 or its regulatory elements, e.g., an indel at or near a target sequence of a gRNA comprising a targeting domain to LILRB1, e.g., comprising a targeting domain listed in Table 6d;

Wherein the cell (or population of cells comprises one or more cells which) expresses the CAR and the NK inhibitory molecule, and exhibits reduced or eliminated expression and/or function of one or more of: i) a component of a TCR (e.g., TRAC, TRBC1 or TRBC2, e.g. TRAC), ii) B2M, iii) NLRC5, and/or iv) LILRB1.

In an aspect, a cell of the invention comprises (e.g., a population of cells of the invention comprises one or more cells which comprise):
 (a) Nucleic acid sequence encoding a CAR, e.g., as described herein;
 (b) An indel at or near a sequence of a gene encoding a component of a TCR (e.g., TRAC, TRBC1 or TRBC2, e.g. TRAC) or its regulatory elements, e.g., an indel at or near a target sequence of a gRNA comprising a targeting domain to a component of a TCR (e.g., TRAC, TRBC1 or TRBC2, e.g. TRAC), e.g., comprising a targeting domain listed in Table 1, Table 4 or Table 5; and
 (c) An indel at or near a sequence of the gene encoding FKBP1A or its regulatory elements, e.g., an indel at or near a target sequence of a gRNA comprising a targeting domain to FKBP1A, e.g., comprising a targeting domain listed in Table 1 or Table 6b;

Wherein the cell (or population of cells comprises one or more cells which) expresses the CAR, and exhibits reduced or eliminated expression and/or function of one or more of: i) a component of a TCR (e.g., TRAC, TRBC1 or TRBC2, e.g. TRAC), and/or ii) FKBP12. Such cells (or population of cells comprising said cells) are particularly useful, for example, in methods of treatment which comprise administering an immunosuppressant (e.g., cyclosporine, rapamycin or rapalog, or mTor inhibitor, e.g., RAD001).

In an aspect, a cell of the invention comprises (e.g., a population of cells of the invention comprises one or more cells which comprise):
 (a) Nucleic acid sequence encoding a CAR, e.g., as described herein;
 (b) Nucleic acid sequence encoding a rapamycin-resistant mTor, e.g., as described herein, e.g., nucleic acid sequence encoding an mTor comprising a S2035 mutation, e.g., an S2035I mutation; and;
 (c) An indel at or near a sequence of a gene encoding a component of a TCR (e.g., TRAC, TRBC1 or TRBC2, e.g. TRAC) or its regulatory elements, e.g., an indel at or near a target sequence of a gRNA comprising a targeting domain to a component of a TCR (e.g., TRAC, TRBC1 or TRBC2, e.g. TRAC), e.g., comprising a targeting domain listed in Table 1, Table 4 or Table 5;

Wherein the cell (or population of cells comprises one or more cells which) expresses the CAR and the rapamycin-resistant mTor, and exhibits reduced or eliminated expression and/or function of a component of a TCR (e.g., TRAC, TRBC1 or TRBC2, e.g. TRAC). Such cells (or population of cells comprising said cells) are particularly useful, for example, in methods of treatment which comprise administering an immunosuppressant (e.g., cyclosporine, rapamycin or rapalog, or mTor inhibitor, e.g., RAD001).

In any of the aforementioned embodiments and aspects the cell comprises one or more CRISPR systems, e.g., as described herein, comprising the gRNA molecule(s) indicated. In embodiments, the cell comprises one or more ribonuclear protein (RNP) complexes each comprising a Cas9 molecule, e.g., as described herein, and a gRNA molecule comprising the indicated targeting domain, e.g., as described herein. In embodiments, including in any of the methods described herein, where gRNAs to more than one target sequence are employed, the gRNAs (and CRISPR systems comprising said gRNAs) may be introduced into the cell simultaneously. In other embodiments, including in any of the methods described herein, where gRNAs to more than one target sequence are employed, the gRNAs (and CRISPR systems comprising said gRNAs) may be introduced into the cell sequentially.

In an aspect involving any of the aforementioned embodiments or aspects, the population of cells comprises at least 20%, e.g., at least 30%, at least 40%, at least 50%, at least 60%, at least 70%, at least 80%, at least 90%, at least 95%, or at least 99%, of cells which include an indel at or near each of the target sequences targeted by each of the gRNA molecules. Said population may be obtained, for example, by utilizing high efficiency gRNA molecules (e.g., gRNA molecules which cause an indel in >85% of said cells which are exposed to said gRNA molecule), or by enriching the population for the desired cell, e.g., by selecting for the desired cell population, e.g., by affinity chromatography or cell sorting.

VII. Template Nucleic Acids (for Introduction of Nucleic Acids)

The term "template nucleic acid" or "donor template" as used herein refers to a nucleic acid to be inserted at or near a target sequence that has been modified, e.g., cleaved, by a CRISPR system of the present invention. In an embodiment, nucleic acid sequence at or near the target sequence is modified to have some or all of the sequence of the template nucleic acid, typically at or near cleavage site(s). In an embodiment, the template nucleic acid is single stranded. In an alternate embodiment, the template nucleic acid is double stranded. In an embodiment, the template nucleic acid is DNA, e.g., double stranded DNA. In an alternate embodiment, the template nucleic acid is single stranded DNA.

In embodiments, the template nucleic acid comprises sequence encoding a chimeric antigen receptor (CAR), e.g., a CAR as described above in section V.

In an embodiment, the template nucleic acid alters the structure of the target position by participating in a homology directed repair event. In an embodiment, the template nucleic acid alters the sequence of the target position. In an embodiment, the template nucleic acid results in the incorporation of a modified, or non-naturally occurring base into the target nucleic acid.

Mutations in a gene or pathway described herein may be corrected using one of the approaches discussed herein. In an embodiment, a mutation in a gene or pathway described herein is corrected by homology directed repair (HDR) using a template nucleic acid. In an embodiment, a mutation in a gene or pathway described herein is corrected by homologous recombination (HR) using a template nucleic acid. In an embodiment, a mutation in a gene or pathway described herein is corrected by Non-Homologous End Joining (NHEJ) repair using a template nucleic acid. In other embodiments, nucleic acid encoding molecules of interest may be inserted at or near a site modified by a CRISPR system of the present invention. In an embodiment, the nucleic acid inserted encodes a chimeric antigen receptor as described herein. In embodiments, the template nucleic acid comprises regulatory elements, e.g., one or more promotors and/or enhancers, operably linked to the nucleic acid sequence encoding a molecule of interest, e.g., a chimeric antigen receptor, e.g., as described herein.

HDR Repair and Template Nucleic Acids

As described herein, nuclease-induced homology directed repair (HDR) can be used to alter a target sequence and correct (e.g., repair or edit) a mutation in the genome. While not wishing to be bound by theory, it is believed that alteration of the target sequence occurs by homology-directed repair (HDR) with a donor template or template nucleic acid. For example, the donor template or the template nucleic acid provides for alteration of the target sequence. It is contemplated that a plasmid donor can be used as a template for homologous recombination. It is further contemplated that a single stranded donor template can be used as a template for alteration of the target sequence by alternate methods of homology directed repair (e.g., single strand annealing) between the target sequence and the donor template. Donor template-effected alteration of a target sequence depends on cleavage by a Cas9 molecule. Cleavage by Cas9 can comprise a double strand break or two single strand breaks.

In an embodiment, a mutation can be corrected by either a single double-strand break or two single strand breaks. In an embodiment, a mutation can be corrected by (1) a single double-strand break, (2) two single strand breaks, (3) two double stranded breaks with a break occurring on each side of the target sequence, (4) one double stranded breaks and two single strand breaks with the double strand break and two single strand breaks occurring on each side of the target sequence or (5) four single stranded breaks with a pair of single stranded breaks occurring on each side of the target sequence.

Double Strand Break Mediated Correction

In an embodiment, double strand cleavage is effected by a Cas9 molecule having cleavage activity associated with an HNH-like domain and cleavage activity associated with a RuvC-like domain, e.g., an N-terminal RuvC-like domain, e.g., a wild type Cas9. Such embodiments require only a single gRNA.

Single Strand Break Mediated Correction

In other embodiments, two single strand breaks, or nicks, are effected by a Cas9 molecule having nickase activity, e.g., cleavage activity associated with an HNH-like domain or cleavage activity associated with an N-terminal RuvC-like domain. Such embodiments require two gRNAs, one for placement of each single strand break. In an embodiment, the Cas9 molecule having nickase activity cleaves the strand to which the gRNA hybridizes, but not the strand that is complementary to the strand to which the gRNA hybridizes. In an embodiment, the Cas9 molecule having nickase activity does not cleave the strand to which the gRNA hybridizes, but rather cleaves the strand that is complementary to the strand to which the gRNA hybridizes.

In an embodiment, the nickase has HNH activity, e.g., a Cas9 molecule having the RuvC activity inactivated, e.g., a Cas9 molecule having a mutation at D10, e.g., the D10A mutation. D10A inactivates RuvC; therefore, the Cas9 nickase has (only) HN H activity and will cut on the strand to which the gRNA hybridizes (e.g., the complementary strand, which does not have the NGG PAM on it). In other embodiments, a Cas9 molecule having an H840, e.g., an H840A, mutation can be used as a nickase. H840A inactivates HNH; therefore, the Cas9 nickase has (only) RuvC activity and cuts on the non-complementary strand (e.g., the strand that has the NGG PAM and whose sequence is identical to the gRNA).

In an embodiment, in which a nickase and two gRNAs are used to position two single strand nicks, one nick is on the + strand and one nick is on the − strand of the target nucleic acid. The PAMs are outwardly facing. The gRNAs can be selected such that the gRNAs are separated by, from about 0-50, 0-100, or 0-200 nucleotides. In an embodiment, there is no overlap between the target sequence that is complementary to the targeting domains of the two gRNAs. In an embodiment, the gRNAs do not overlap and are separated by as much as 50, 100, or 200 nucleotides. In an embodiment, the use of two gRNAs can increase specificity, e.g., by decreasing off-target binding (Ran el cil., CELL 2013).

In an embodiment, a single nick can be used to induce HDR. It is contemplated herein that a single nick can be used to increase the ratio of HDR, HR or NHEJ at a given cleavage site.

Placement of the Double Strand Break or a Single Strand Break Relative to Target Position The double strand break or single strand break in one of the strands should be sufficiently close to target position such that correction occurs. In an embodiment, the distance is not more than 50, 100, 200, 300, 350 or 400 nucleotides. While not wishing to be bound by theory, it is believed that the break should be sufficiently close to target position such that the break is within the region that is subject to exonuclease-mediated removal during end resection. If the distance between the target position and a break is too great, the mutation may not be included in the end resection and, therefore, may not be corrected, as donor sequence may only be used to correct sequence within the end resection region.

In an embodiment, in which a gRNA (unimolecular (or chimeric) or modular gRNA) and Cas9 nuclease induce a double strand break for the purpose of inducing HDR- or HR-mediated correction, the cleavage site is between 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position. In an embodiment, the cleavage site is between 0-100 bp (e.g., 0 to 75, 0 to 50, 0 to 25, 25 to 100, 25 to 25 to 50, 50 to 100, 50 to 75 or 75 to 100 bp) away from the target position.

In an embodiment, in which two gRNAs (independently, unimolecular (or chimeric) or modular gRNA) complexing with Cas9 nickases induce two single strand breaks for the purpose of inducing HDR-mediated correction, the closer nick is between 0-200 bp (e.g., 0 to 175, 0 to 150, 0 to 125, 0 to 100, 0 to 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position and the two nicks will ideally be within 25-55 bp of each other (e.g., 25 to 25 to 45, 25 to 40, 25 to 35, 25 to 30, 30 to 55, 30 to 50, 30 to 45, 30 to 40, 30 to 35, 35 to 55, 35 to 35 to 45, 35 to 40, 40 to 55, 40 to 50, 40 to 45 bp) and no more than 100 bp away from each other (e.g., no more than 90, 80, 70, 60, 50, 40, 30, 20, 10 or 5 bp away from each other). In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In one embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a Cas9 nuclease) and two single strand breaks or paired single stranded breaks (i.e., two gRNAs complex with Cas9 nickases) on either side of the target position (e.g., the first gRNA is used to target upstream (i.e., 5') of the target position and the second gRNA is used to target downstream (i.e., 3') of the target position). In another embodiment, four gRNAs, e.g., independently, unimolecular (or chimeric) or modular gRNA, are configured to generate two pairs of single stranded breaks (i.e., two pairs of two gRNAs complex with Cas9 nickases) on either side of the target position (e.g., the first gRNA is used to target upstream (i.e., 5') of the target position and the second gRNA is used to target downstream (i.e., 3') of the target position). The double strand break(s) or the closer of the two single strand nicks in a pair will ideally be within 0-500 bp of the target position (e.g., no more than 450, 400, 350, 300, 250, 200, 150,100, 50 or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 30 to 50, 35. to 50, 40 to 50, 45 to 50, 35 to 45, or 40 to 45 bp) and no more than 100 bp away from each other (e.g., no more than 90, 80, 70, 60, 50, 40, 30, 20 or 10 bp).

In one embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a Cas9 nuclease) and two single strand breaks or paired single stranded breaks (i.e., two gRNAs complex with Cas9 nickases) on two target sequences (e.g., the first gRNA is used to target an upstream (i.e., 5') target sequence and the second gRNA is used to target a downstream (i.e., 3') target sequence of an insertion site. In another embodiment, four gRNAs, e.g., independently, unimolecular (or chimeric) or modular gRNA, are configured to generate two pairs of single stranded breaks (i.e., two pairs of two gRNAs complex with Cas9 nickases) on either side of an insertion site (e.g., the first gRNA is used to target an upstream (i.e., target sequence described herein, and the second gRNA is used to target a downstream (i.e., 3') target sequence described herein). The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp).

Length of the Homology Arms

The homology arm should extend at least as far as the region in which end resection may occur, e.g., in order to allow the resected single stranded overhang to find a complementary region within the donor template. The overall length could be limited by parameters such as plasmid size or viral packaging limits. In an embodiment, a homology arm does not extend into repeated elements, e.g., ALU repeats, LINE repeats. A template may have two homology arms of the same or different lengths.

Exemplary homology arm lengths include at least 25, 50, 100, 250, 500, 750 or 1000 nucleotides.

Target position, as used herein, refers to a site on a target nucleic acid (e.g., the chromosome) that is modified by a Cas9 molecule-dependent process. For example, the target position can be a modified Cas9 molecule cleavage of the target nucleic acid and template nucleic acid directed modification, e.g., correction, of the target position. In an embodiment, a target position can be a site between two nucleotides, e.g., adjacent nucleotides, on the target nucleic acid into which one or more nucleotides is added. The target position may comprise one or more nucleotides that are altered, e.g., corrected, by a template nucleic acid. In an embodiment, the target position is within a target sequence (e.g., the sequence to which the gRNA binds). In an embodiment, a target position is upstream or downstream of a target sequence (e.g., the sequence to which the gRNA binds).

Typically, the template sequence undergoes a breakage mediated or catalyzed recombination with the target sequence. In an embodiment, the template nucleic acid includes sequence that corresponds to a site on the target sequence that is cleaved by a Cas9 mediated cleavage event. In an embodiment, the template nucleic acid includes sequence that corresponds to both, a first site on the target sequence that is cleaved in a first Cas9 mediated event, and a second site on the target sequence that is cleaved in a second Cas9 mediated event.

In an embodiment, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation.

In other embodiments, the template nucleic acid can include sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

The template nucleic acid can include sequence which, when integrated, results in:
  decreasing the activity of a positive control element;
  increasing the activity of a positive control element;
  decreasing the activity of a negative control element;
  increasing the activity of a negative control element;
  decreasing the expression of a gene;
  increasing the expression of a gene;
  increasing resistance to a disorder or disease;
  increasing resistance to viral entry;
  correcting a mutation or altering an unwanted amino acid residue
  conferring, increasing, abolishing or decreasing a biological property of a gene product, e.g., increasing the enzymatic activity of an enzyme, or increasing the ability of a gene product to interact with another molecule.

The template nucleic acid can include sequence which results in:
  a change in sequence of 1, 2, 3, 4, 5, 6, 7, 8, 9, 10, 11, 12 or more nucleotides of the target sequence.

In an embodiment, the template nucleic acid is 20+/−10, 30+/−10, 40+/−10, 50+/−10, 60+/−10, 70+/−10, 10, 90+/−10, 100+/−10, 110+/−10, 120+/−10, 130+/−10, 140+/−10, 150+/−10, 160+/−10, 170+/−80+/−10, 190+/−10, 200+/−10, 210+/−10, 220+/−10, 200-300, 300-400, 400-500, 500-600, 600-700, 700-800, 800-900, 900-1000, 1000-2000, 2000-3000 or more than 3000 nucleotides in length.

A template nucleic acid comprises the following components:
  [5' homology arm]-[insertion sequence]-[3' homology arm].

The homology arms provide for recombination into the chromosome, which can replace the undesired element, e.g., a mutation or signature, with the replacement sequence. In an embodiment, the homology arms flank the most distal cleavage sites.

In an embodiment, the 3' end of the 5' homology arm is the position next to the 5' end of the replacement sequence. In an embodiment, the 5' homology arm can extend at least 10, 20, 30, 40, 50, 60, 70, 80, 90, 100, 120, 150, 180, 200, 300, 400, 500, 600, 700, 800, 900, 1000, 1500, or 2000 nucleotides 5' from the 5' end of the replacement sequence.

In an embodiment, the 5' end of the 3' homology arm is the position next to the 3' end of the replacement sequence. In an embodiment, the 3' homology arm can extend at least 10, 20, 30, 40, 50, 60, 70, 80, 90, 100, 120, 150, 180, 200, 300, 400, 500, 600, 700, 800, 900, 1000, 1500, or 2000 nucleotides 3' from the 3' end of the replacement sequence.

It is contemplated herein that one or both homology arms may be shortened to avoid including certain sequence repeat elements, e.g., Alu repeats, LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

It is contemplated herein that template nucleic acids for correcting a mutation may designed for use as a single-stranded oligonucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made.

In one aspect, the insertion sequence comprises nucleic acid sequence that encodes a chimeric antigen receptor, e.g., as described herein. In one embodiment the insertion sequence further comprises a promotor operably linked to the nucleic acid sequence encoding a chimeric antigen receptor, e.g., an EF-1 alpha promoter. In one aspect, the insertion sequence comprises a vector encoding a chimeric antigen receptor, e.g., as described herein, or a portion thereof.

NHEJ Approaches for Gene Targeting

As described herein, nuclease-induced non-homologous end-joining (NHEJ) can be used to target gene-specific knockouts. Nuclease-induced NHEJ can also be used to remove (e.g., delete) sequence in a gene of interest.

While not wishing to be bound by theory, it is believed that, in an embodiment, the genomic alterations associated with the methods described herein rely on nuclease-induced NHEJ and the error-prone nature of the NHEJ repair pathway. NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. Two-thirds of these mutations may alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein.

The indel mutations generated by NHEJ are unpredictable in nature; however, at a given break site certain indel sequences are favored and are over represented in the population. The lengths of deletions can vary widely; most commonly in the 1-50 bp range, but they can easily reach greater than 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it can also be used to delete small sequence motifs as long as the generation of a specific final sequence is not required. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. Both of these approaches can be used to delete specific DNA sequences; however, the error-prone nature of NHEJ may still produce indel mutations at the site of repair.

Both double strand cleaving Cas9 molecules and single strand, or nickase, Cas9 molecules can be used in the methods and compositions described herein to generate NHEJ-mediated indels. NHEJ-mediated indels targeted to the gene, e.g., a coding region, e.g., an early coding region of a gene of interest can be used to knockout (i.e., eliminate expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp).

Placement of Double Strand or Single Strand Breaks Relative to the Target Position In an embodiment, in which a gRNA and Cas9 nuclease generate a double strand break for the purpose of inducing NHEJ-mediated indels, a gRNA, e.g., a unimolecular (or chimeric) or modular gRNA molecule, is configured to position one double-strand break in close proximity to a nucleotide of the target position. In an embodiment, the cleavage site is between 0-500 bp away from the target position (e.g., less than 500, 400, 300, 200, 100, 50, 40, 30, 25, 20, 15, 10, 9, 8, 7, 6, 5, 4, 3, 2 or 1 bp from the target position).

In an embodiment, in which two gRNAs complexing with Cas9 nickases induce two single strand breaks for the purpose of inducing NHEJ-mediated indels, two gRNAs, e.g., independently, unimolecular (or chimeric) or modular gRNA, are configured to position two single-strand breaks to provide for NHEJ repair a nucleotide of the target position. In an embodiment, the gRNAs are configured to position cuts at the same position, or within a few nucleotides of one another, on different strands, essentially mimicking a double strand break. In an embodiment, the closer nick is between 0-30 bp away from the target position (e.g., less than 30, 25, 20, 1, 10, 9, 8, 7, 6, 5, 4, 3, 2 or 1 bp from the target position), and the two nicks are within 25-55 bp of each other (e.g., between 25 to 50, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp). In an embodiment, the gRNAs are configured to place a single strand break on either side of a nucleotide of the target position.

Both double strand cleaving Cas9 molecules and single strand, or nickase, Cas9 molecules can be used in the methods and compositions described herein to generate breaks both sides of a target position. Double strand or paired single strand breaks may be generated on both sides of a target position to remove the nucleic acid sequence between the two cuts (e.g., the region between the two breaks is deleted). In one embodiment, two gRNAs, e.g., independently, unimolecular (or chimeric) or modular gRNA, are configured to position a double-strand break on both sides of a target position (e.g., the first gRNA is used to target upstream (i.e., 5') of the mutation in a gene or pathway described herein, and the second gRNA is used to target downstream (i.e., 3') of the mutation in a gene or pathway described herein). In an alternate embodiment, three gRNAs, e.g., independently, unimolecular (or chimeric) or modular gRNA, are configured to position a double strand break (i.e., one gRNA complexes with a Cas9 nuclease) and two single strand breaks or paired single stranded breaks (i.e., two gRNAs complex with Cas9 nickases) on either side of a target position (e.g., the first gRNA is used to target upstream (i.e., 5') of the mutation in a gene or pathway described herein, and the second gRNA is used to target downstream (i.e., 3') of the mutation in a gene or pathway described herein). In another embodiment, four gRNAs, e.g., independently, unimolecular (or chimeric) or modular gRNA, are configured to generate two pairs of single stranded breaks (i.e., two pairs of two gRNAs complex with Cas9 nickases) on either side of the target position (e.g., the first gRNA is used to target upstream (i.e., 5') of the mutation in a gene or pathway described herein, and the second gRNA is used to target downstream (i.e., 3') of the mutation in a gene or pathway described herein). The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are within 25-55 bp of each other (e.g., between 25 to 50, 25 to 45, 25 to 40, 25 to 35, 25 to 30, 50 to 45 to 55, 40 to 55, 35 to 55, 30 to 55, 30 to 50, 35 to 50, 40 to 50, 45 to 50, 35 to 45, or 40 to 45 bp) and no more than 100 bp away from each other (e.g., no more than 90, 80, 70, 60, 50, 40, 30, 20 or 10 bp).

VIII. Systems Comprising More than One gRNA Molecule

While not intending to be bound by theory, it has been surprisingly shown herein that the targeting of two target sequences (e.g., by two gRNA molecule/Cas9 molecule complexes which each induce a single- or double-strand break at or near their respective target sequences) located in close proximity on a continuous nucleic acid induces excision (e.g., deletion) of the nucleic acid sequence (or at least 80%, 85%, 90%, 95%, 96%, 97%, 98%, 99% of the nucleic acid sequence) located between the two target sequences. In some aspects, the present disclosure provides for the use of two or more gRNA molecules that comprise targeting domains targeting target sequences in close proximity on a continuous nucleic acid, e.g., a chromosome, e.g., a gene or gene locus, including its introns, exons and regulatory elements. The use may be, for example, by introduction of the two or more gRNA molecules, together with one or more Cas9 molecules (or nucleic acid encoding the two or more gRNA molecules and/or the one or more Cas9 molecules) into a cell.

In some aspects, the target sequences of the two or more gRNA molecules are located at least 5, 6, 7, 8, 9, 20, 30, 40, 50, 60, 70, 80, 90, 100, 200, 300, 400, 500, 600, 700, 800, 900, 1000, 2000, 3000, 4000, 5000, 6000, or 70000 nucleotides apart on a continuous nucleic acid, but not more than 10000 nucleotides apart on a continuous nucleic acid. In an embodiment, the target sequences are located about 4000 nucleotides apart. In an embodiment, the target sequences are located about 6000 nucleotides apart.

In some aspects, the plurality of gRNA molecules each target sequences within the same gene or gene locus. In another aspect, the plurality of gRNA molecules each target sequences within 2 or more different genes.

In some aspects, the invention provides compositions and cells comprising a plurality, for example, 2 or more, for example, 2, gRNA molecules of the invention, wherein the plurality of gRNA molecules target sequences less than 10,000, less than 9,000, less than 8,000, less than 7,000, less than 6,000, less than less than 4,000, less than 3,000, less than 2,000, less than 1,000, less than 900, less than 800, less than 700, less than 600, less than 500, less than 400, less than 300, less than 200, less than 100, less than less than 80, less than 70, less than 60, less than 50, less than 40, or less than 30 nucleotides apart. In an embodiment, the target sequences are on the same strand of duplex nucleic acid. In an embodiment, the target sequences are on different strands of duplex nucleic acid.

In one embodiment, the invention provides a method for excising (e.g., deleting) nucleic acid disposed between two gRNA binding sites disposed less than 10,000, less than 9,000, less than 8,000, less than 7,000, less than 6,000, less than 5,000, less than 4,000, less than 3,000, less than 2,000, less than 1,000, less than 900, less than 800, less than 700, less than 600, less than 500, less than 400, less than 300, less than 200, less than 100, less than 90, less than 80, less than 70, less than 60, less than 50, less than 40, or less than 30 nucleotides apart on the same or different strands of duplex nucleic acid. In an embodiment, the method provides for deletion of more than 50%, more than 60%, more than 70%, more than 80%, more than 85%, more than 86%, more than 87%, more than 88%, more than 89%, more than 90%, more than 91%, more than 92%, more than 93%, more than 94%, more than 95%, more than 96%, more than 97%, more than 98%, more than 99%, or 100% of the nucleotides disposed between the PAM sites associated with each gRNA binding site. In embodiments, the deletion further comprises of one or more nucleotides within one or more of the PAM sites associated with each gRNA binding site. In embodiments, the deletion also comprises one or more nucleotides outside of the region between the PAM sites associated with each gRNA binding site.

In one aspect, the two or more gRNA molecules comprise targeting domains targeting target sequences flanking a gene regulatory element, e.g., a promotor binding site, an enhancer region, or a repressor region, such that excision of the intervening sequence (or a portion of the intervening sequence) causes up- or down-regulation of a gene of interest.

In an embodiment, the two or more gRNA molecules are selected from the gRNA molecules of Table 1. In aspects, the two or more gRNA molecules comprise targeting domains that are complementary with sequences in the same gene. In aspects, the two or more gRNA molecules comprise targeting domains that are complementary with sequences of different genes. In an embodiment, the two or more gRNA molecules are selected from the gRNA molecules of Table 2. In aspects, the two or more gRNA molecules comprise targeting domains that are complementary with sequences in the same gene. In aspects, the two or more gRNA molecules comprise targeting domains that are complementary with sequences of different genes. In an embodiment, the two or more gRNA molecules are selected from the gRNA molecules of Table 3. In an embodiment, the two or more gRNA molecules are selected from the gRNA molecules of Table 4. In an embodiment, the two or more gRNA molecules are selected from the gRNA molecules of Table 5. In an embodiment, the two or more gRNA molecules are selected from the gRNA molecules of Table 6. In an embodiment, the first and second gRNA molecules are selected from Tables 1-6, and are selected from different tables, e.g., and comprise targeting domains that are complementary with sequences of different genes. In embodiments, such two or more gRNA molecules may additionally be combined with one or more additional gRNA molecules which are complementary to a target domain of a different gene, as described herein.

In aspects of the invention that utilize two or more, e.g., two, gRNA molecules, it may be particularly useful for a first gRNA molecule (or more than one gRNA molecules) to comprise a targeting domain specific for a sequence of TRAC and a second gRNA molecule (or more than one gRNA molecules) to comprise a targeting domain specific for a sequence of B2M. In such aspects, it is particularly preferred that the first gRNA molecule to TRAC comprises a targeting domain of any gRNA molecule of FIG. 12, and the second gRNA molecule to B2M comprises a targeting domain of any gRNA molecule of FIG. 14. In an aspect, the first gRNA molecule to TRAC includes a targeting domain comprising, e.g., consisting of, SEQ ID NO: 5569, SEQ ID NO: 5587, SEQ ID NO: 5592 or SEQ ID NO: 5586, and the second gRNA molecule to B2M includes a targeting domain comprising, e.g., consisting of, SEQ ID NO: 5496, SEQ ID NO: 5498, or SEQ ID NO: 5509. In an aspect, the first gRNA molecule and the second gRNA molecule include targeting domains comprising, e.g., consisting of, SEQ ID NO: 5569 and SEQ ID NO: 5519, respectively. In an aspect, the first gRNA molecule and the second gRNA molecule include targeting domains comprising, e.g., consisting of, SEQ ID NO: 5569 and SEQ ID NO: 5497, respectively. In an aspect, the first gRNA molecule and the second gRNA molecule include targeting domains comprising, e.g., consisting of, SEQ ID NO: 5569 and SEQ ID NO: 5499, respectively. In an aspect, the first gRNA molecule and the second gRNA molecule include targeting domains comprising, e.g., consisting of, SEQ ID NO: 5569 and SEQ ID NO: 5498, respectively. In an aspect, the first gRNA molecule and the second gRNA molecule include targeting domains comprising, e.g., consisting of, SEQ ID NO: 5569 and SEQ ID NO: 5503, respectively. In an aspect, the first gRNA molecule and the second gRNA molecule include targeting domains comprising, e.g., consisting of, SEQ ID NO: 5569 and SEQ ID NO: 5496, respectively. In an aspect, the first gRNA molecule and the second gRNA molecule include targeting domains comprising, e.g., consisting of, SEQ ID NO: 5569 and SEQ ID NO: 5507, respectively. In an aspect, the first gRNA molecule and the second gRNA molecule include targeting domains comprising, e.g., consisting of, SEQ ID NO: 5569 and SEQ ID NO: 5515, respectively. In an aspect, the first gRNA molecule and the second gRNA molecule include targeting domains comprising, e.g., consisting of, SEQ ID NO: 5569 and SEQ ID NO: 5493, respectively. In an aspect, the first gRNA molecule and the second gRNA molecule include targeting domains comprising, e.g., consisting of, SEQ ID NO: 5569 and SEQ ID NO: 5506, respectively. In an aspect, the first gRNA molecule and the second gRNA molecule include targeting domains comprising, e.g., consisting of, SEQ ID NO: 5569 and SEQ ID NO: 5509, respectively. In an aspect, the first gRNA molecule and the second gRNA molecule include targeting domains comprising, e.g., consisting of, SEQ ID NO: 5569 and SEQ ID NO: 5517, respectively. In an aspect, the first gRNA molecule and the second gRNA molecule include targeting domains comprising, e.g., consisting of, SEQ ID NO: 5569 and SEQ ID NO: 5521, respectively. In an aspect, the first gRNA molecule and the second gRNA molecule include targeting domains comprising, e.g., consisting of, SEQ ID NO: 5569 and SEQ ID NO: 5520, respectively. In an aspect, the first gRNA molecule and the second gRNA molecule include targeting domains comprising, e.g., consisting of, SEQ ID NO: 5569 and SEQ ID NO: 5500, respectively. In an aspect, the first gRNA molecule and the second gRNA molecule include targeting domains comprising, e.g., consisting of, SEQ ID NO: 5569 and SEQ ID NO: 5494, respectively. In an aspect, the first gRNA molecule and the second gRNA molecule include targeting domains comprising, e.g., consisting of, SEQ ID NO: 5569 and SEQ ID NO: 5508, respectively. In an aspect, the first gRNA molecule and the second gRNA molecule include targeting domains comprising, e.g., consisting of, SEQ ID NO: 5569 and SEQ ID NO: 5514, respectively. In an aspect, the first gRNA molecule and the second gRNA molecule include targeting domains comprising, e.g., consisting of, SEQ ID NO: 5569 and SEQ ID NO: 5492, respectively. In an aspect, the first gRNA molecule and the second gRNA molecule include targeting domains comprising, e.g., consisting of, SEQ ID NO: 5585 and SEQ ID NO: 5519, respectively. In an aspect, the first gRNA molecule and the second gRNA molecule include targeting domains comprising, e.g., consisting of, SEQ ID NO: 5585 and SEQ ID NO: 5497, respectively. In an aspect, the first gRNA molecule and the second gRNA molecule include targeting domains comprising, e.g., consisting of, SEQ ID NO: 5585 and SEQ ID NO: 5499, respectively. In an aspect, the first gRNA molecule and the second gRNA molecule include targeting domains comprising, e.g., consisting of, SEQ ID NO: 5585 and SEQ ID NO: 5498, respectively. In an aspect, the first gRNA molecule and the second gRNA molecule include targeting domains comprising, e.g., consisting of, SEQ ID NO: 5585 and SEQ ID NO: 5503, respectively. In an aspect, the first gRNA molecule and the second gRNA molecule include targeting domains comprising, e.g., consisting of, SEQ ID NO: 5585 and SEQ ID NO: 5496, respectively. In an aspect, the first gRNA molecule and the second gRNA molecule include targeting domains comprising, e.g., consisting of, SEQ ID NO: 5585 and SEQ ID NO: 5507, respectively. In an aspect, the first gRNA molecule and the second gRNA molecule include targeting domains comprising, e.g., consisting of, SEQ ID NO: 5585 and SEQ ID NO: 5515, respectively. In an aspect, the first gRNA molecule and the second gRNA molecule include targeting domains comprising, e.g., consisting of, SEQ ID NO: 5585 and SEQ ID NO: 5493, respectively. In an aspect, the first gRNA molecule and the second gRNA molecule include targeting domains comprising, e.g., consisting of, SEQ ID NO: 5585 and SEQ ID NO: 5506, respectively. In an aspect, the first gRNA molecule and the second gRNA molecule include targeting domains comprising, e.g., consisting of, SEQ ID NO: 5585 and SEQ ID NO: 5509, respectively. In an aspect, the first gRNA molecule and the second gRNA molecule include targeting domains comprising, e.g., consisting of, SEQ ID NO: 5585 and SEQ ID NO: 5517, respectively. In an aspect, the first gRNA molecule and the second gRNA molecule include targeting domains comprising, e.g., consisting of, SEQ ID NO: 5585 and SEQ ID NO: 5521, respectively. In an aspect, the first gRNA molecule and the second gRNA molecule include targeting domains comprising, e.g., consisting of, SEQ ID NO: 5585 and SEQ ID NO: 5520, respectively. In an aspect, the first gRNA molecule and the second gRNA molecule include targeting domains comprising, e.g., consisting of, SEQ ID NO: 5585 and SEQ ID NO: 5500, respectively. In an aspect, the first gRNA molecule and the second gRNA molecule include targeting domains comprising, e.g., consisting of, SEQ ID NO: 5585 and SEQ ID NO: 5494, respectively. In an aspect, the first gRNA molecule and the second gRNA molecule include targeting domains comprising, e.g., consisting of, SEQ ID NO: 5585 and SEQ ID NO: 5508, respectively. In an aspect, the first gRNA molecule and the second gRNA molecule include targeting domains comprising, e.g., consisting of, SEQ ID NO: 5585 and SEQ ID NO: 5514, respectively. In an aspect, the first gRNA molecule and the second gRNA molecule include targeting domains comprising, e.g., consisting of, SEQ ID NO: 5585 and SEQ ID NO: 5492, respectively. In an aspect, the first gRNA molecule and the second gRNA molecule include targeting domains comprising, e.g., consisting of, SEQ ID NO: 5592 and SEQ ID NO: 5519, respectively. In an aspect, the first gRNA molecule and the second gRNA molecule include targeting domains comprising, e.g., consisting of, SEQ ID NO: 5592 and SEQ ID NO: 5497, respectively. In an aspect, the first gRNA molecule and the second gRNA molecule include targeting domains comprising, e.g., consisting of, SEQ ID NO: 5592 and SEQ ID NO: 5499, respectively. In an aspect, the first gRNA molecule and the second gRNA molecule include targeting domains comprising, e.g., consisting of, SEQ ID NO: 5592 and SEQ ID NO: 5498, respectively. In an aspect, the first gRNA molecule and the second gRNA molecule include targeting domains comprising, e.g., consisting of, SEQ ID NO: 5592 and SEQ ID NO: 5503, respectively. In an aspect, the first gRNA molecule and the second gRNA molecule include targeting domains comprising, e.g., consisting of, SEQ ID NO: 5592 and SEQ ID NO: 5496, respectively. In an aspect, the first gRNA molecule and the second gRNA molecule include targeting domains comprising, e.g., consisting of, SEQ ID NO: 5592 and SEQ ID NO: 5507, respectively. In an aspect, the first gRNA molecule and the second gRNA molecule include targeting domains comprising, e.g., consisting of, SEQ ID NO: 5592 and SEQ ID NO: 5515, respectively. In an aspect, the first gRNA molecule and the second gRNA molecule include targeting domains comprising, e.g., consisting of, SEQ ID NO: 5592 and SEQ ID NO: 5493, respectively. In an aspect, the first gRNA molecule and the second gRNA molecule include targeting domains comprising, e.g., consisting of, SEQ ID NO: 5592 and SEQ ID NO: 5506, respectively. In an aspect, the first gRNA molecule and the second gRNA molecule include targeting domains comprising, e.g., consisting of, SEQ ID NO: 5592 and SEQ ID NO: 5509, respectively. In an aspect, the first gRNA molecule and the second gRNA molecule include targeting domains comprising, e.g., consisting of, SEQ ID NO: 5592 and SEQ ID NO: 5517, respectively. In an aspect, the first gRNA molecule and the second gRNA molecule include targeting domains comprising, e.g., consisting of, SEQ ID NO: 5592 and SEQ ID NO: 5521, respectively. In an aspect, the first gRNA molecule and the second gRNA molecule include targeting domains comprising, e.g., consisting of, SEQ ID NO: 5592 and SEQ ID NO: 5520, respectively. In an aspect, the first gRNA molecule and the second gRNA molecule include targeting domains comprising, e.g., consisting of, SEQ ID NO: 5592 and SEQ ID NO: 5500, respectively. In an aspect, the first gRNA molecule and the second gRNA molecule include targeting domains comprising, e.g., consisting of, SEQ ID NO: 5592 and SEQ ID NO: 5494, respectively. In an aspect, the first gRNA molecule and the second gRNA molecule include targeting domains comprising, e.g., consisting of, SEQ ID NO: 5592 and SEQ ID NO: 5508, respectively. In an aspect, the first gRNA molecule and the second gRNA molecule include targeting domains comprising, e.g., consisting of, SEQ ID NO: 5592 and SEQ ID NO: 5514, respectively. In an aspect, the first gRNA molecule and the second gRNA molecule include targeting domains comprising, e.g., consisting of, SEQ ID NO: 5592 and SEQ ID NO: 5492, respectively. In an aspect, the first gRNA molecule and the second gRNA molecule include targeting domains comprising, e.g., consisting of, SEQ ID NO: 5601 and SEQ ID NO: 5519, respectively. In an aspect, the first gRNA molecule and the second gRNA molecule include targeting domains comprising, e.g., consisting of, SEQ ID NO: 5601 and SEQ ID NO: 5497, respectively. In an aspect, the first gRNA molecule and the second gRNA molecule include targeting domains comprising, e.g., consisting of, SEQ ID NO: 5601 and SEQ ID NO: 5499, respectively. In an aspect, the first gRNA molecule and the second gRNA molecule include targeting domains comprising, e.g., consisting of, SEQ ID NO: 5601 and SEQ ID NO: 5498, respectively. In an aspect, the first gRNA molecule and the second gRNA molecule include targeting domains comprising, e.g., consisting of, SEQ ID NO: 5601 and SEQ ID NO: 5503, respectively. In an aspect, the first gRNA molecule and the second gRNA molecule include targeting domains comprising, e.g., consisting of, SEQ ID NO: 5601 and SEQ ID NO: 5496, respectively. In an aspect, the first gRNA molecule and the second gRNA molecule include targeting domains comprising, e.g., consisting of, SEQ ID NO: 5601 and SEQ ID NO: 5507, respectively. In an aspect, the first gRNA molecule and the second gRNA molecule include targeting domains comprising, e.g., consisting of, SEQ ID NO: 5601 and SEQ ID NO: 5515, respectively. In an aspect, the first gRNA molecule and the second gRNA molecule include targeting domains comprising, e.g., consisting of, SEQ ID NO: 5601 and SEQ ID NO: 5493, respectively. In an aspect, the first gRNA molecule and the second gRNA molecule include targeting domains comprising, e.g., consisting of, SEQ ID NO: 5601 and SEQ ID NO: 5506, respectively. In an aspect, the first gRNA molecule and the second gRNA molecule include targeting domains comprising, e.g., consisting of, SEQ ID NO: 5601 and SEQ ID NO: 5509, respectively. In an aspect, the first gRNA molecule and the second gRNA molecule include targeting domains comprising, e.g., consisting of, SEQ ID NO: 5601 and SEQ ID NO: 5517, respectively. In an aspect, the first gRNA molecule and the second gRNA molecule include targeting domains comprising, e.g., consisting of, SEQ ID NO: 5601 and SEQ ID NO: 5521, respectively. In an aspect, the first gRNA molecule and the second gRNA molecule include targeting domains comprising, e.g., consisting of, SEQ ID NO: 5601 and SEQ ID NO: 5520, respectively. In an aspect, the first gRNA molecule and the second gRNA molecule include targeting domains comprising, e.g., consisting of, SEQ ID NO: 5601 and SEQ ID NO: 5500, respectively. In an aspect, the first gRNA molecule and the second gRNA molecule include targeting domains comprising, e.g., consisting of, SEQ ID NO: 5601 and SEQ ID NO: 5494, respectively. In an aspect, the first gRNA molecule and the second gRNA molecule include targeting domains comprising, e.g., consisting of, SEQ ID NO: 5601 and SEQ ID NO: 5508, respectively. In an aspect, the first gRNA molecule and the second gRNA molecule include targeting domains comprising, e.g., consisting of, SEQ ID NO: 5601 and SEQ ID NO: 5514, respectively. In an aspect, the first gRNA molecule and the second gRNA molecule include targeting domains comprising, e.g., consisting of, SEQ ID NO: 5601 and SEQ ID NO: 5492, respectively. In an aspect, the first gRNA molecule and the second gRNA molecule include targeting domains comprising, e.g., consisting of, SEQ ID NO: 5589 and SEQ ID NO: 5519, respectively. In an aspect, the first gRNA molecule and the second gRNA molecule include targeting domains comprising, e.g., consisting of, SEQ ID NO: 5589 and SEQ ID NO: 5497, respectively. In an aspect, the first gRNA molecule and the second gRNA molecule include targeting domains comprising, e.g., consisting of, SEQ ID NO: 5589 and SEQ ID NO: 5499, respectively. In an aspect, the first gRNA molecule and the second gRNA molecule include targeting domains comprising, e.g., consisting of, SEQ ID NO: 5589 and SEQ ID NO: 5498, respectively. In an aspect, the first gRNA molecule and the second gRNA molecule include targeting domains comprising, e.g., consisting of, SEQ ID NO: 5589 and SEQ ID NO: 5503, respectively. In an aspect, the first gRNA molecule and the second gRNA molecule include targeting domains comprising, e.g., consisting of, SEQ ID NO: 5589 and SEQ ID NO: 5496, respectively. In an aspect, the first gRNA molecule and the second gRNA molecule include targeting domains comprising, e.g., consisting of, SEQ ID NO: 5589 and SEQ ID NO: 5507, respectively. In an aspect, the first gRNA molecule and the second gRNA molecule include targeting domains comprising, e.g., consisting of, SEQ ID NO: 5589 and SEQ ID NO: 5515, respectively. In an aspect, the first gRNA molecule and the second gRNA molecule include targeting domains comprising, e.g., consisting of, SEQ ID NO: 5589 and SEQ ID NO: 5493, respectively. In an aspect, the first gRNA molecule and the second gRNA molecule include targeting domains comprising, e.g., consisting of, SEQ ID NO: 5589 and SEQ ID NO: 5506, respectively. In an aspect, the first gRNA molecule and the second gRNA molecule include targeting domains comprising, e.g., consisting of, SEQ ID NO: 5589 and SEQ ID NO: 5509, respectively. In an aspect, the first gRNA molecule and the second gRNA molecule include targeting domains comprising, e.g., consisting of, SEQ ID NO: 5589 and SEQ ID NO: 5517, respectively. In an aspect, the first gRNA molecule and the second gRNA molecule include targeting domains comprising, e.g., consisting of, SEQ ID NO: 5589 and SEQ ID NO: 5521, respectively. In an aspect, the first gRNA molecule and the second gRNA molecule include targeting domains comprising, e.g., consisting of, SEQ ID NO: 5589 and SEQ ID NO: 5520, respectively. In an aspect, the first gRNA molecule and the second gRNA molecule include targeting domains comprising, e.g., consisting of, SEQ ID NO: 5589 and SEQ ID NO: 5500, respectively. In an aspect, the first gRNA molecule and the second gRNA molecule include targeting domains comprising, e.g., consisting of, SEQ ID NO: 5589 and SEQ ID NO: 5494, respectively. In an aspect, the first gRNA molecule and the second gRNA molecule include targeting domains comprising, e.g., consisting of, SEQ ID NO: 5589 and SEQ ID NO: 5508, respectively. In an aspect, the first gRNA molecule and the second gRNA molecule include targeting domains comprising, e.g., consisting of, SEQ ID NO: 5589 and SEQ ID NO: 5514, respectively. In an aspect, the first gRNA molecule and the second gRNA molecule include targeting domains comprising, e.g., consisting of, SEQ ID NO: 5589 and SEQ ID NO: 5492, respectively. In an aspect, the first gRNA molecule and the second gRNA molecule include targeting domains comprising, e.g., consisting of, SEQ ID NO: 5600 and SEQ ID NO: 5519, respectively. In an aspect, the first gRNA molecule and the second gRNA molecule include targeting domains comprising, e.g., consisting of, SEQ ID NO: 5600 and SEQ ID NO: 5497, respectively. In an aspect, the first gRNA molecule and the second gRNA molecule include targeting domains comprising, e.g., consisting of, SEQ ID NO: 5600 and SEQ ID NO: 5499, respectively. In an aspect, the first gRNA molecule and the second gRNA molecule include targeting domains comprising, e.g., consisting of, SEQ ID NO: 5600 and SEQ ID NO: 5498, respectively. In an aspect, the first gRNA molecule and the second gRNA molecule include targeting domains comprising, e.g., consisting of, SEQ ID NO: 5600 and SEQ ID NO: 5503, respectively. In an aspect, the first gRNA molecule and the second gRNA molecule include targeting domains comprising, e.g., consisting of, SEQ ID NO: 5600 and SEQ ID NO: 5496, respectively. In an aspect, the first gRNA molecule and the second gRNA molecule include targeting domains comprising, e.g., consisting of, SEQ ID NO: 5600 and SEQ ID NO: 5507, respectively. In an aspect, the first gRNA molecule and the second gRNA molecule include targeting domains comprising, e.g., consisting of, SEQ ID NO: 5600 and SEQ ID NO: 5515, respectively. In an aspect, the first gRNA molecule and the second gRNA molecule include targeting domains comprising, e.g., consisting of, SEQ ID NO: 5600 and SEQ ID NO: 5493, respectively. In an aspect, the first gRNA molecule and the second gRNA molecule include targeting domains comprising, e.g., consisting of, SEQ ID NO: 5600 and SEQ ID NO: 5506, respectively. In an aspect, the first gRNA molecule and the second gRNA molecule include targeting domains comprising, e.g., consisting of, SEQ ID NO: 5600 and SEQ ID NO: 5509, respectively. In an aspect, the first gRNA molecule and the second gRNA molecule include targeting domains comprising, e.g., consisting of, SEQ ID NO: 5600 and SEQ ID NO: 5517, respectively. In an aspect, the first gRNA molecule and the second gRNA molecule include targeting domains comprising, e.g., consisting of, SEQ ID NO: 5600 and SEQ ID NO: 5521, respectively. In an aspect, the first gRNA molecule and the second gRNA molecule include targeting domains comprising, e.g., consisting of, SEQ ID NO: 5600 and SEQ ID NO: 5520, respectively. In an aspect, the first gRNA molecule and the second gRNA molecule include targeting domains comprising, e.g., consisting of, SEQ ID NO: 5600 and SEQ ID NO: 5500, respectively. In an aspect, the first gRNA molecule and the second gRNA molecule include targeting domains comprising, e.g., consisting of, SEQ ID NO: 5600 and SEQ ID NO: 5494, respectively. In an aspect, the first gRNA molecule and the second gRNA molecule include targeting domains comprising, e.g., consisting of, SEQ ID NO: 5600 and SEQ ID NO: 5508, respectively. In an aspect, the first gRNA molecule and the second gRNA molecule include targeting domains comprising, e.g., consisting of, SEQ ID NO: 5600 and SEQ ID NO: 5514, respectively. In an aspect, the first gRNA molecule and the second gRNA molecule include targeting domains comprising, e.g., consisting of, SEQ ID NO: 5600 and SEQ ID NO: 5492, respectively. In an aspect, the first gRNA molecule and the second gRNA molecule include targeting domains comprising, e.g., consisting of, SEQ ID NO: 5594 and SEQ ID NO: 5519, respectively. In an aspect, the first gRNA molecule and the second gRNA molecule include targeting domains comprising, e.g., consisting of, SEQ ID NO: 5594 and SEQ ID NO: 5497, respectively. In an aspect, the first gRNA molecule and the second gRNA molecule include targeting domains comprising, e.g., consisting of, SEQ ID NO: 5594 and SEQ ID NO: 5499, respectively. In an aspect, the first gRNA molecule and the second gRNA molecule include targeting domains comprising, e.g., consisting of, SEQ ID NO: 5594 and SEQ ID NO: 5498, respectively. In an aspect, the first gRNA molecule and the second gRNA molecule include targeting domains comprising, e.g., consisting of, SEQ ID NO: 5594 and SEQ ID NO: 5503, respectively. In an aspect, the first gRNA molecule and the second gRNA molecule include targeting domains comprising, e.g., consisting of, SEQ ID NO: 5594 and SEQ ID NO: 5496, respectively. In an aspect, the first gRNA molecule and the second gRNA molecule include targeting domains comprising, e.g., consisting of, SEQ ID NO: 5594 and SEQ ID NO: 5507, respectively. In an aspect, the first gRNA molecule and the second gRNA molecule include targeting domains comprising, e.g., consisting of, SEQ ID NO: 5594 and SEQ ID NO: 5515, respectively. In an aspect, the first gRNA molecule and the second gRNA molecule include targeting domains comprising, e.g., consisting of, SEQ ID NO: 5594 and SEQ ID NO: 5493, respectively. In an aspect, the first gRNA molecule and the second gRNA molecule include targeting domains comprising, e.g., consisting of, SEQ ID NO: 5594 and SEQ ID NO: 5506, respectively. In an aspect, the first gRNA molecule and the second gRNA molecule include targeting domains comprising, e.g., consisting of, SEQ ID NO: 5594 and SEQ ID NO: 5509, respectively. In an aspect, the first gRNA molecule and the second gRNA molecule include targeting domains comprising, e.g., consisting of, SEQ ID NO: 5594 and SEQ ID NO: 5517, respectively. In an aspect, the first gRNA molecule and the second gRNA molecule include targeting domains comprising, e.g., consisting of, SEQ ID NO: 5594 and SEQ ID NO: 5521, respectively. In an aspect, the first gRNA molecule and the second gRNA molecule include targeting domains comprising, e.g., consisting of, SEQ ID NO: 5594 and SEQ ID NO: 5520, respectively. In an aspect, the first gRNA molecule and the second gRNA molecule include targeting domains comprising, e.g., consisting of, SEQ ID NO: 5594 and SEQ ID NO: 5500, respectively. In an aspect, the first gRNA molecule and the second gRNA molecule include targeting domains comprising, e.g., consisting of, SEQ ID NO: 5594 and SEQ ID NO: 5494, respectively. In an aspect, the first gRNA molecule and the second gRNA molecule include targeting domains comprising, e.g., consisting of, SEQ ID NO: 5594 and SEQ ID NO: 5508, respectively. In an aspect, the first gRNA molecule and the second gRNA molecule include targeting domains comprising, e.g., consisting of, SEQ ID NO: 5594 and SEQ ID NO: 5514, respectively. In an aspect, the first gRNA molecule and the second gRNA molecule include targeting domains comprising, e.g., consisting of, SEQ ID NO: 5594 and SEQ ID NO: 5492, respectively. In an aspect, the first gRNA molecule and the second gRNA molecule include targeting domains comprising, e.g., consisting of, SEQ ID NO: 5571 and SEQ ID NO: 5519, respectively. In an aspect, the first gRNA molecule and the second gRNA molecule include targeting domains comprising, e.g., consisting of, SEQ ID NO: 5571 and SEQ ID NO: 5497, respectively. In an aspect, the first gRNA molecule and the second gRNA molecule include targeting domains comprising, e.g., consisting of, SEQ ID NO: 5571 and SEQ ID NO: 5499, respectively. In an aspect, the first gRNA molecule and the second gRNA molecule include targeting domains comprising, e.g., consisting of, SEQ ID NO: 5571 and SEQ ID NO: 5498, respectively. In an aspect, the first gRNA molecule and the second gRNA molecule include targeting domains comprising, e.g., consisting of, SEQ ID NO: 5571 and SEQ ID NO: 5503, respectively. In an aspect, the first gRNA molecule and the second gRNA molecule include targeting domains comprising, e.g., consisting of, SEQ ID NO: 5571 and SEQ ID NO: 5496, respectively. In an aspect, the first gRNA molecule and the second gRNA molecule include targeting domains comprising, e.g., consisting of, SEQ ID NO: 5571 and SEQ ID NO: 5507, respectively. In an aspect, the first gRNA molecule and the second gRNA molecule include targeting domains comprising, e.g., consisting of, SEQ ID NO: 5571 and SEQ ID NO: 5515, respectively. In an aspect, the first gRNA molecule and the second gRNA molecule include targeting domains comprising, e.g., consisting of, SEQ ID NO: 5571 and SEQ ID NO: 5493, respectively. In an aspect, the first gRNA molecule and the second gRNA molecule include targeting domains comprising, e.g., consisting of, SEQ ID NO: 5571 and SEQ ID NO: 5506, respectively. In an aspect, the first gRNA molecule and the second gRNA molecule include targeting domains comprising, e.g., consisting of, SEQ ID NO: 5571 and SEQ ID NO: 5509, respectively. In an aspect, the first gRNA molecule and the second gRNA molecule include targeting domains comprising, e.g., consisting of, SEQ ID NO: 5571 and SEQ ID NO: 5517, respectively. In an aspect, the first gRNA molecule and the second gRNA molecule include targeting domains comprising, e.g., consisting of, SEQ ID NO: 5571 and SEQ ID NO: 5521, respectively. In an aspect, the first gRNA molecule and the second gRNA molecule include targeting domains comprising, e.g., consisting of, SEQ ID NO: 5571 and SEQ ID NO: 5520, respectively. In an aspect, the first gRNA molecule and the second gRNA molecule include targeting domains comprising, e.g., consisting of, SEQ ID NO: 5571 and SEQ ID NO: 5500, respectively. In an aspect, the first gRNA molecule and the second gRNA molecule include targeting domains comprising, e.g., consisting of, SEQ ID NO: 5571 and SEQ ID NO: 5494, respectively. In an aspect, the first gRNA molecule and the second gRNA molecule include targeting domains comprising, e.g., consisting of, SEQ ID NO: 5571 and SEQ ID NO: 5508, respectively. In an aspect, the first gRNA molecule and the second gRNA molecule include targeting domains comprising, e.g., consisting of, SEQ ID NO: 5571 and SEQ ID NO: 5514, respectively. In an aspect, the first gRNA molecule and the second gRNA molecule include targeting domains comprising, e.g., consisting of, SEQ ID NO: 5571 and SEQ ID NO: 5492, respectively. In an aspect, the first gRNA molecule and the second gRNA molecule include targeting domains comprising, e.g., consisting of, SEQ ID NO: 5593 and SEQ ID NO: 5519, respectively. In an aspect, the first gRNA molecule and the second gRNA molecule include targeting domains comprising, e.g., consisting of, SEQ ID NO: 5593 and SEQ ID NO: 5497, respectively. In an aspect, the first gRNA molecule and the second gRNA molecule include targeting domains comprising, e.g., consisting of, SEQ ID NO: 5593 and SEQ ID NO: 5499, respectively. In an aspect, the first gRNA molecule and the second gRNA molecule include targeting domains comprising, e.g., consisting of, SEQ ID NO: 5593 and SEQ ID NO: 5498, respectively. In an aspect, the first gRNA molecule and the second gRNA molecule include targeting domains comprising, e.g., consisting of, SEQ ID NO: 5593 and SEQ ID NO: 5503, respectively. In an aspect, the first gRNA molecule and the second gRNA molecule include targeting domains comprising, e.g., consisting of, SEQ ID NO: 5593 and SEQ ID NO: 5496, respectively. In an aspect, the first gRNA molecule and the second gRNA molecule include targeting domains comprising, e.g., consisting of, SEQ ID NO: 5593 and SEQ ID NO: 5507, respectively. In an aspect, the first gRNA molecule and the second gRNA molecule include targeting domains comprising, e.g., consisting of, SEQ ID NO: 5593 and SEQ ID NO: 5515, respectively. In an aspect, the first gRNA molecule and the second gRNA molecule include targeting domains comprising, e.g., consisting of, SEQ ID NO: 5593 and SEQ ID NO: 5493, respectively. In an aspect, the first gRNA molecule and the second gRNA molecule include targeting domains comprising, e.g., consisting of, SEQ ID NO: 5593 and SEQ ID NO: 5506, respectively. In an aspect, the first gRNA molecule and the second gRNA molecule include targeting domains comprising, e.g., consisting of, SEQ ID NO: 5593 and SEQ ID NO: 5509, respectively. In an aspect, the first gRNA molecule and the second gRNA molecule include targeting domains comprising, e.g., consisting of, SEQ ID NO: 5593 and SEQ ID NO: 5517, respectively. In an aspect, the first gRNA molecule and the second gRNA molecule include targeting domains comprising, e.g., consisting of, SEQ ID NO: 5593 and SEQ ID NO: 5521, respectively. In an aspect, the first gRNA molecule and the second gRNA molecule include targeting domains comprising, e.g., consisting of, SEQ ID NO: 5593 and SEQ ID NO: 5520, respectively. In an aspect, the first gRNA molecule and the second gRNA molecule include targeting domains comprising, e.g., consisting of, SEQ ID NO: 5593 and SEQ ID NO: 5500, respectively. In an aspect, the first gRNA molecule and the second gRNA molecule include targeting domains comprising, e.g., consisting of, SEQ ID NO: 5593 and SEQ ID NO: 5494, respectively. In an aspect, the first gRNA molecule and the second gRNA molecule include targeting domains comprising, e.g., consisting of, SEQ ID NO: 5593 and SEQ ID NO: 5508, respectively. In an aspect, the first gRNA molecule and the second gRNA molecule include targeting domains comprising, e.g., consisting of, SEQ ID NO: 5593 and SEQ ID NO: 5514, respectively. In an aspect, the first gRNA molecule and the second gRNA molecule include targeting domains comprising, e.g., consisting of, SEQ ID NO: 5593 and SEQ ID NO: 5492, respectively. In an aspect, the first gRNA molecule and the second gRNA molecule include targeting domains comprising, e.g., consisting of, SEQ ID NO: 5574 and SEQ ID NO: 5519, respectively. In an aspect, the first gRNA molecule and the second gRNA molecule include targeting domains comprising, e.g., consisting of, SEQ ID NO: 5574 and SEQ ID NO: 5497, respectively. In an aspect, the first gRNA molecule and the second gRNA molecule include targeting domains comprising, e.g., consisting of, SEQ ID NO: 5574 and SEQ ID NO: 5499, respectively. In an aspect, the first gRNA molecule and the second gRNA molecule include targeting domains comprising, e.g., consisting of, SEQ ID NO: 5574 and SEQ ID NO: 5498, respectively. In an aspect, the first gRNA molecule and the second gRNA molecule include targeting domains comprising, e.g., consisting of, SEQ ID NO: 5574 and SEQ ID NO: 5503, respectively. In an aspect, the first gRNA molecule and the second gRNA molecule include targeting domains comprising, e.g., consisting of, SEQ ID NO: 5574 and SEQ ID NO: 5496, respectively. In an aspect, the first gRNA molecule and the second gRNA molecule include targeting domains comprising, e.g., consisting of, SEQ ID NO: 5574 and SEQ ID NO: 5507, respectively. In an aspect, the first gRNA molecule and the second gRNA molecule include targeting domains comprising, e.g., consisting of, SEQ ID NO: 5574 and SEQ ID NO: 5515, respectively. In an aspect, the first gRNA molecule and the second gRNA molecule include targeting domains comprising, e.g., consisting of, SEQ ID NO: 5574 and SEQ ID NO: 5493, respectively. In an aspect, the first gRNA molecule and the second gRNA molecule include targeting domains comprising, e.g., consisting of, SEQ ID NO: 5574 and SEQ ID NO: 5506, respectively. In an aspect, the first gRNA molecule and the second gRNA molecule include targeting domains comprising, e.g., consisting of, SEQ ID NO: 5574 and SEQ ID NO: 5509, respectively. In an aspect, the first gRNA molecule and the second gRNA molecule include targeting domains comprising, e.g., consisting of, SEQ ID NO: 5574 and SEQ ID NO: 5517, respectively. In an aspect, the first gRNA molecule and the second gRNA molecule include targeting domains comprising, e.g., consisting of, SEQ ID NO: 5574 and SEQ ID NO: 5521, respectively. In an aspect, the first gRNA molecule and the second gRNA molecule include targeting domains comprising, e.g., consisting of, SEQ ID NO: 5574 and SEQ ID NO: 5520, respectively. In an aspect, the first gRNA molecule and the second gRNA molecule include targeting domains comprising, e.g., consisting of, SEQ ID NO: 5574 and SEQ ID NO: 5500, respectively. In an aspect, the first gRNA molecule and the second gRNA molecule include targeting domains comprising, e.g., consisting of, SEQ ID NO: 5574 and SEQ ID NO: 5494, respectively. In an aspect, the first gRNA molecule and the second gRNA molecule include targeting domains comprising, e.g., consisting of, SEQ ID NO: 5574 and SEQ ID NO: 5508, respectively. In an aspect, the first gRNA molecule and the second gRNA molecule include targeting domains comprising, e.g., consisting of, SEQ ID NO: 5574 and SEQ ID NO: 5514, respectively. In an aspect, the first gRNA molecule and the second gRNA molecule include targeting domains comprising, e.g., consisting of, SEQ ID NO: 5574 and SEQ ID NO: 5492, respectively. In an aspect, the first gRNA molecule and the second gRNA molecule include targeting domains comprising, e.g., consisting of, SEQ ID NO: 5598 and SEQ ID NO: 5519, respectively. In an aspect, the first gRNA molecule and the second gRNA molecule include targeting domains comprising, e.g., consisting of, SEQ ID NO: 5598 and SEQ ID NO: 5497, respectively. In an aspect, the first gRNA molecule and the second gRNA molecule include targeting domains comprising, e.g., consisting of, SEQ ID NO: 5598 and SEQ ID NO: 5499, respectively. In an aspect, the first gRNA molecule and the second gRNA molecule include targeting domains comprising, e.g., consisting of, SEQ ID NO: 5598 and SEQ ID NO: 5498, respectively. In an aspect, the first gRNA molecule and the second gRNA molecule include targeting domains comprising, e.g., consisting of, SEQ ID NO: 5598 and SEQ ID NO: 5503, respectively. In an aspect, the first gRNA molecule and the second gRNA molecule include targeting domains comprising, e.g., consisting of, SEQ ID NO: 5598 and SEQ ID NO: 5496, respectively. In an aspect, the first gRNA molecule and the second gRNA molecule include targeting domains comprising, e.g., consisting of, SEQ ID NO: 5598 and SEQ ID NO: 5507, respectively. In an aspect, the first gRNA molecule and the second gRNA molecule include targeting domains comprising, e.g., consisting of, SEQ ID NO: 5598 and SEQ ID NO: 5515, respectively. In an aspect, the first gRNA molecule and the second gRNA molecule include targeting domains comprising, e.g., consisting of, SEQ ID NO: 5598 and SEQ ID NO: 5493, respectively. In an aspect, the first gRNA molecule and the second gRNA molecule include targeting domains comprising, e.g., consisting of, SEQ ID NO: 5598 and SEQ ID NO: 5506, respectively. In an aspect, the first gRNA molecule and the second gRNA molecule include targeting domains comprising, e.g., consisting of, SEQ ID NO: 5598 and SEQ ID NO: 5509, respectively. In an aspect, the first gRNA molecule and the second gRNA molecule include targeting domains comprising, e.g., consisting of, SEQ ID NO: 5598 and SEQ ID NO: 5517, respectively. In an aspect, the first gRNA molecule and the second gRNA molecule include targeting domains comprising, e.g., consisting of, SEQ ID NO: 5598 and SEQ ID NO: 5521, respectively. In an aspect, the first gRNA molecule and the second gRNA molecule include targeting domains comprising, e.g., consisting of, SEQ ID NO: 5598 and SEQ ID NO: 5520, respectively. In an aspect, the first gRNA molecule and the second gRNA molecule include targeting domains comprising, e.g., consisting of, SEQ ID NO: 5598 and SEQ ID NO: 5500, respectively. In an aspect, the first gRNA molecule and the second gRNA molecule include targeting domains comprising, e.g., consisting of, SEQ ID NO: 5598 and SEQ ID NO: 5494, respectively. In an aspect, the first gRNA molecule and the second gRNA molecule include targeting domains comprising, e.g., consisting of, SEQ ID NO: 5598 and SEQ ID NO: 5508, respectively. In an aspect, the first gRNA molecule and the second gRNA molecule include targeting domains comprising, e.g., consisting of, SEQ ID NO: 5598 and SEQ ID NO: 5514, respectively. In an aspect, the first gRNA molecule and the second gRNA molecule include targeting domains comprising, e.g., consisting of, SEQ ID NO: 5598 and SEQ ID NO: 5492, respectively. In an aspect, the first gRNA molecule and the second gRNA molecule include targeting domains comprising, e.g., consisting of, SEQ ID NO: 5586 and SEQ ID NO: 5519, respectively. In an aspect, the first gRNA molecule and the second gRNA molecule include targeting domains comprising, e.g., consisting of, SEQ ID NO: 5586 and SEQ ID NO: 5497, respectively. In an aspect, the first gRNA molecule and the second gRNA molecule include targeting domains comprising, e.g., consisting of, SEQ ID NO: 5586 and SEQ ID NO: 5499, respectively. In an aspect, the first gRNA molecule and the second gRNA molecule include targeting domains comprising, e.g., consisting of, SEQ ID NO: 5586 and SEQ ID NO: 5498, respectively. In an aspect, the first gRNA molecule and the second gRNA molecule include targeting domains comprising, e.g., consisting of, SEQ ID NO: 5586 and SEQ ID NO: 5503, respectively. In an aspect, the first gRNA molecule and the second gRNA molecule include targeting domains comprising, e.g., consisting of, SEQ ID NO: 5586 and SEQ ID NO: 5496, respectively. In an aspect, the first gRNA molecule and the second gRNA molecule include targeting domains comprising, e.g., consisting of, SEQ ID NO: 5586 and SEQ ID NO: 5507, respectively. In an aspect, the first gRNA molecule and the second gRNA molecule include targeting domains comprising, e.g., consisting of, SEQ ID NO: 5586 and SEQ ID NO: 5515, respectively. In an aspect, the first gRNA molecule and the second gRNA molecule include targeting domains comprising, e.g., consisting of, SEQ ID NO: 5586 and SEQ ID NO: 5493, respectively. In an aspect, the first gRNA molecule and the second gRNA molecule include targeting domains comprising, e.g., consisting of, SEQ ID NO: 5586 and SEQ ID NO: 5506, respectively. In an aspect, the first gRNA molecule and the second gRNA molecule include targeting domains comprising, e.g., consisting of, SEQ ID NO: 5586 and SEQ ID NO: 5509, respectively. In an aspect, the first gRNA molecule and the second gRNA molecule include targeting domains comprising, e.g., consisting of, SEQ ID NO: 5586 and SEQ ID NO: 5517, respectively. In an aspect, the first gRNA molecule and the second gRNA molecule include targeting domains comprising, e.g., consisting of, SEQ ID NO: 5586 and SEQ ID NO: 5521, respectively. In an aspect, the first gRNA molecule and the second gRNA molecule include targeting domains comprising, e.g., consisting of, SEQ ID NO: 5586 and SEQ ID NO: 5520, respectively. In an aspect, the first gRNA molecule and the second gRNA molecule include targeting domains comprising, e.g., consisting of, SEQ ID NO: 5586 and SEQ ID NO: 5500, respectively. In an aspect, the first gRNA molecule and the second gRNA molecule include targeting domains comprising, e.g., consisting of, SEQ ID NO: 5586 and SEQ ID NO: 5494, respectively. In an aspect, the first gRNA molecule and the second gRNA molecule include targeting domains comprising, e.g., consisting of, SEQ ID NO: 5586 and SEQ ID NO: 5508, respectively. In an aspect, the first gRNA molecule and the second gRNA molecule include targeting domains comprising, e.g., consisting of, SEQ ID NO: 5586 and SEQ ID NO: 5514, respectively. In an aspect, the first gRNA molecule and the second gRNA molecule include targeting domains comprising, e.g., consisting of, SEQ ID NO: 5586 and SEQ ID NO: 5492, respectively. In an aspect, the first gRNA molecule and the second gRNA molecule include targeting domains comprising, e.g., consisting of, SEQ ID NO: 5599 and SEQ ID NO: 5519, respectively. In an aspect, the first gRNA molecule and the second gRNA molecule include targeting domains comprising, e.g., consisting of, SEQ ID NO: 5599 and SEQ ID NO: 5497, respectively. In an aspect, the first gRNA molecule and the second gRNA molecule include targeting domains comprising, e.g., consisting of, SEQ ID NO: 5599 and SEQ ID NO: 5499, respectively. In an aspect, the first gRNA molecule and the second gRNA molecule include targeting domains comprising, e.g., consisting of, SEQ ID NO: 5599 and SEQ ID NO: 5498, respectively. In an aspect, the first gRNA molecule and the second gRNA molecule include targeting domains comprising, e.g., consisting of, SEQ ID NO: 5599 and SEQ ID NO: 5503, respectively. In an aspect, the first gRNA molecule and the second gRNA molecule include targeting domains comprising, e.g., consisting of, SEQ ID NO: 5599 and SEQ ID NO: 5496, respectively. In an aspect, the first gRNA molecule and the second gRNA molecule include targeting domains comprising, e.g., consisting of, SEQ ID NO: 5599 and SEQ ID NO: 5507, respectively. In an aspect, the first gRNA molecule and the second gRNA molecule include targeting domains comprising, e.g., consisting of, SEQ ID NO: 5599 and SEQ ID NO: 5515, respectively. In an aspect, the first gRNA molecule and the second gRNA molecule include targeting domains comprising, e.g., consisting of, SEQ ID NO: 5599 and SEQ ID NO: 5493, respectively. In an aspect, the first gRNA molecule and the second gRNA molecule include targeting domains comprising, e.g., consisting of, SEQ ID NO: 5599 and SEQ ID NO: 5506, respectively. In an aspect, the first gRNA molecule and the second gRNA molecule include targeting domains comprising, e.g., consisting of, SEQ ID NO: 5599 and SEQ ID NO: 5509, respectively. In an aspect, the first gRNA molecule and the second gRNA molecule include targeting domains comprising, e.g., consisting of, SEQ ID NO: 5599 and SEQ ID NO: 5517, respectively. In an aspect, the first gRNA molecule and the second gRNA molecule include targeting domains comprising, e.g., consisting of, SEQ ID NO: 5599 and SEQ ID NO: 5521, respectively. In an aspect, the first gRNA molecule and the second gRNA molecule include targeting domains comprising, e.g., consisting of, SEQ ID NO: 5599 and SEQ ID NO: 5520, respectively. In an aspect, the first gRNA molecule and the second gRNA molecule include targeting domains comprising, e.g., consisting of, SEQ ID NO: 5599 and SEQ ID NO: 5500, respectively. In an aspect, the first gRNA molecule and the second gRNA molecule include targeting domains comprising, e.g., consisting of, SEQ ID NO: 5599 and SEQ ID NO: 5494, respectively. In an aspect, the first gRNA molecule and the second gRNA molecule include targeting domains comprising, e.g., consisting of, SEQ ID NO: 5599 and SEQ ID NO: 5508, respectively. In an aspect, the first gRNA molecule and the second gRNA molecule include targeting domains comprising, e.g., consisting of, SEQ ID NO: 5599 and SEQ ID NO: 5514, respectively. In an aspect, the first gRNA molecule and the second gRNA molecule include targeting domains comprising, e.g., consisting of, SEQ ID NO: 5599 and SEQ ID NO: 5492, respectively. In an aspect, the first gRNA molecule and the second gRNA molecule include targeting domains comprising, e.g., consisting of, SEQ ID NO: 5591 and SEQ ID NO: 5519, respectively. In an aspect, the first gRNA molecule and the second gRNA molecule include targeting domains comprising, e.g., consisting of, SEQ ID NO: 5591 and SEQ ID NO: 5497, respectively. In an aspect, the first gRNA molecule and the second gRNA molecule include targeting domains comprising, e.g., consisting of, SEQ ID NO: 5591 and SEQ ID NO: 5499, respectively. In an aspect, the first gRNA molecule and the second gRNA molecule include targeting domains comprising, e.g., consisting of, SEQ ID NO: 5591 and SEQ ID NO: 5498, respectively. In an aspect, the first gRNA molecule and the second gRNA molecule include targeting domains comprising, e.g., consisting of, SEQ ID NO: 5591 and SEQ ID NO: 5503, respectively. In an aspect, the first gRNA molecule and the second gRNA molecule include targeting domains comprising, e.g., consisting of, SEQ ID NO: 5591 and SEQ ID NO: 5496, respectively. In an aspect, the first gRNA molecule and the second gRNA molecule include targeting domains comprising, e.g., consisting of, SEQ ID NO: 5591 and SEQ ID NO: 5507, respectively. In an aspect, the first gRNA molecule and the second gRNA molecule include targeting domains comprising, e.g., consisting of, SEQ ID NO: 5591 and SEQ ID NO: 5515, respectively. In an aspect, the first gRNA molecule and the second gRNA molecule include targeting domains comprising, e.g., consisting of, SEQ ID NO: 5591 and SEQ ID NO: 5493, respectively. In an aspect, the first gRNA molecule and the second gRNA molecule include targeting domains comprising, e.g., consisting of, SEQ ID NO: 5591 and SEQ ID NO: 5506, respectively. In an aspect, the first gRNA molecule and the second gRNA molecule include targeting domains comprising, e.g., consisting of, SEQ ID NO: 5591 and SEQ ID NO: 5509, respectively. In an aspect, the first gRNA molecule and the second gRNA molecule include targeting domains comprising, e.g., consisting of, SEQ ID NO: 5591 and SEQ ID NO: 5517, respectively. In an aspect, the first gRNA molecule and the second gRNA molecule include targeting domains comprising, e.g., consisting of, SEQ ID NO: 5591 and SEQ ID NO: 5521, respectively. In an aspect, the first gRNA molecule and the second gRNA molecule include targeting domains comprising, e.g., consisting of, SEQ ID NO: 5591 and SEQ ID NO: 5520, respectively. In an aspect, the first gRNA molecule and the second gRNA molecule include targeting domains comprising, e.g., consisting of, SEQ ID NO: 5591 and SEQ ID NO: 5500, respectively. In an aspect, the first gRNA molecule and the second gRNA molecule include targeting domains comprising, e.g., consisting of, SEQ ID NO: 5591 and SEQ ID NO: 5494, respectively. In an aspect, the first gRNA molecule and the second gRNA molecule include targeting domains comprising, e.g., consisting of, SEQ ID NO: 5591 and SEQ ID NO: 5508, respectively. In an aspect, the first gRNA molecule and the second gRNA molecule include targeting domains comprising, e.g., consisting of, SEQ ID NO: 5591 and SEQ ID NO: 5514, respectively. In an aspect, the first gRNA molecule and the second gRNA molecule include targeting domains comprising, e.g., consisting of, SEQ ID NO: 5591 and SEQ ID NO: 5492, respectively. In an aspect, the first gRNA molecule and the second gRNA molecule include targeting domains comprising, e.g., consisting of, SEQ ID NO: 5568 and SEQ ID NO: 5519, respectively. In an aspect, the first gRNA molecule and the second gRNA molecule include targeting domains comprising, e.g., consisting of, SEQ ID NO: 5568 and SEQ ID NO: 5497, respectively. In an aspect, the first gRNA molecule and the second gRNA molecule include targeting domains comprising, e.g., consisting of, SEQ ID NO: 5568 and SEQ ID NO: 5499, respectively. In an aspect, the first gRNA molecule and the second gRNA molecule include targeting domains comprising, e.g., consisting of, SEQ ID NO: 5568 and SEQ ID NO: 5498, respectively. In an aspect, the first gRNA molecule and the second gRNA molecule include targeting domains comprising, e.g., consisting of, SEQ ID NO: 5568 and SEQ ID NO: 5503, respectively. In an aspect, the first gRNA molecule and the second gRNA molecule include targeting domains comprising, e.g., consisting of, SEQ ID NO: 5568 and SEQ ID NO: 5496, respectively. In an aspect, the first gRNA molecule and the second gRNA molecule include targeting domains comprising, e.g., consisting of, SEQ ID NO: 5568 and SEQ ID NO: 5507, respectively. In an aspect, the first gRNA molecule and the second gRNA molecule include targeting domains comprising, e.g., consisting of, SEQ ID NO: 5568 and SEQ ID NO: 5515, respectively. In an aspect, the first gRNA molecule and the second gRNA molecule include targeting domains comprising, e.g., consisting of, SEQ ID NO: 5568 and SEQ ID NO: 5493, respectively. In an aspect, the first gRNA molecule and the second gRNA molecule include targeting domains comprising, e.g., consisting of, SEQ ID NO: 5568 and SEQ ID NO: 5506, respectively. In an aspect, the first gRNA molecule and the second gRNA molecule include targeting domains comprising, e.g., consisting of, SEQ ID NO: 5568 and SEQ ID NO: 5509, respectively. In an aspect, the first gRNA molecule and the second gRNA molecule include targeting domains comprising, e.g., consisting of, SEQ ID NO: 5568 and SEQ ID NO: 5517, respectively. In an aspect, the first gRNA molecule and the second gRNA molecule include targeting domains comprising, e.g., consisting of, SEQ ID NO: 5568 and SEQ ID NO: 5521, respectively. In an aspect, the first gRNA molecule and the second gRNA molecule include targeting domains comprising, e.g., consisting of, SEQ ID NO: 5568 and SEQ ID NO: 5520, respectively. In an aspect, the first gRNA molecule and the second gRNA molecule include targeting domains comprising, e.g., consisting of, SEQ ID NO: 5568 and SEQ ID NO: 5500, respectively. In an aspect, the first gRNA molecule and the second gRNA molecule include targeting domains comprising, e.g., consisting of, SEQ ID NO: 5568 and SEQ ID NO: 5494, respectively. In an aspect, the first gRNA molecule and the second gRNA molecule include targeting domains comprising, e.g., consisting of, SEQ ID NO: 5568 and SEQ ID NO: 5508, respectively. In an aspect, the first gRNA molecule and the second gRNA molecule include targeting domains comprising, e.g., consisting of, SEQ ID NO: 5568 and SEQ ID NO: 5514, respectively. In an aspect, the first gRNA molecule and the second gRNA molecule include targeting domains comprising, e.g., consisting of, SEQ ID NO: 5568 and SEQ ID NO: 5492, respectively. In an aspect, the first gRNA molecule and the second gRNA molecule include targeting domains comprising, e.g., consisting of, SEQ ID NO: 5610 and SEQ ID NO: 5519, respectively. In an aspect, the first gRNA molecule and the second gRNA molecule include targeting domains comprising, e.g., consisting of, SEQ ID NO: 5610 and SEQ ID NO: 5497, respectively. In an aspect, the first gRNA molecule and the second gRNA molecule include targeting domains comprising, e.g., consisting of, SEQ ID NO: 5610 and SEQ ID NO: 5499, respectively. In an aspect, the first gRNA molecule and the second gRNA molecule include targeting domains comprising, e.g., consisting of, SEQ ID NO: 5610 and SEQ ID NO: 5498, respectively. In an aspect, the first gRNA molecule and the second gRNA molecule include targeting domains comprising, e.g., consisting of, SEQ ID NO: 5610 and SEQ ID NO: 5503, respectively. In an aspect, the first gRNA molecule and the second gRNA molecule include targeting domains comprising, e.g., consisting of, SEQ ID NO: 5610 and SEQ ID NO: 5496, respectively. In an aspect, the first gRNA molecule and the second gRNA molecule include targeting domains comprising, e.g., consisting of, SEQ ID NO: 5610 and SEQ ID NO: 5507, respectively. In an aspect, the first gRNA molecule and the second gRNA molecule include targeting domains comprising, e.g., consisting of, SEQ ID NO: 5610 and SEQ ID NO: 5515, respectively. In an aspect, the first gRNA molecule and the second gRNA molecule include targeting domains comprising, e.g., consisting of, SEQ ID NO: 5610 and SEQ ID NO: 5493, respectively. In an aspect, the first gRNA molecule and the second gRNA molecule include targeting domains comprising, e.g., consisting of, SEQ ID NO: 5610 and SEQ ID NO: 5506, respectively. In an aspect, the first gRNA molecule and the second gRNA molecule include targeting domains comprising, e.g., consisting of, SEQ ID NO: 5610 and SEQ ID NO: 5509, respectively. In an aspect, the first gRNA molecule and the second gRNA molecule include targeting domains comprising, e.g., consisting of, SEQ ID NO: 5610 and SEQ ID NO: 5517, respectively. In an aspect, the first gRNA molecule and the second gRNA molecule include targeting domains comprising, e.g., consisting of, SEQ ID NO: 5610 and SEQ ID NO: 5521, respectively. In an aspect, the first gRNA molecule and the second gRNA molecule include targeting domains comprising, e.g., consisting of, SEQ ID NO: 5610 and SEQ ID NO: 5520, respectively. In an aspect, the first gRNA molecule and the second gRNA molecule include targeting domains comprising, e.g., consisting of, SEQ ID NO: 5610 and SEQ ID NO: 5500, respectively. In an aspect, the first gRNA molecule and the second gRNA molecule include targeting domains comprising, e.g., consisting of, SEQ ID NO: 5610 and SEQ ID NO: 5494, respectively. In an aspect, the first gRNA molecule and the second gRNA molecule include targeting domains comprising, e.g., consisting of, SEQ ID NO: 5610 and SEQ ID NO: 5508, respectively. In an aspect, the first gRNA molecule and the second gRNA molecule include targeting domains comprising, e.g., consisting of, SEQ ID NO: 5610 and SEQ ID NO: 5514, respectively. In an aspect, the first gRNA molecule and the second gRNA molecule include targeting domains comprising, e.g., consisting of, SEQ ID NO: 5610 and SEQ ID NO: 5492, respectively. In an aspect, the first gRNA molecule and the second gRNA molecule include targeting domains comprising, e.g., consisting of, SEQ ID NO: 5608 and SEQ ID NO: 5519, respectively. In an aspect, the first gRNA molecule and the second gRNA molecule include targeting domains comprising, e.g., consisting of, SEQ ID NO: 5608 and SEQ ID NO: 5497, respectively. In an aspect, the first gRNA molecule and the second gRNA molecule include targeting domains comprising, e.g., consisting of, SEQ ID NO: 5608 and SEQ ID NO: 5499, respectively. In an aspect, the first gRNA molecule and the second gRNA molecule include targeting domains comprising, e.g., consisting of, SEQ ID NO: 5608 and SEQ ID NO: 5498, respectively. In an aspect, the first gRNA molecule and the second gRNA molecule include targeting domains comprising, e.g., consisting of, SEQ ID NO: 5608 and SEQ ID NO: 5503, respectively. In an aspect, the first gRNA molecule and the second gRNA molecule include targeting domains comprising, e.g., consisting of, SEQ ID NO: 5608 and SEQ ID NO: 5496, respectively. In an aspect, the first gRNA molecule and the second gRNA molecule include targeting domains comprising, e.g., consisting of, SEQ ID NO: 5608 and SEQ ID NO: 5507, respectively. In an aspect, the first gRNA molecule and the second gRNA molecule include targeting domains comprising, e.g., consisting of, SEQ ID NO: 5608 and SEQ ID NO: 5515, respectively. In an aspect, the first gRNA molecule and the second gRNA molecule include targeting domains comprising, e.g., consisting of, SEQ ID NO: 5608 and SEQ ID NO: 5493, respectively. In an aspect, the first gRNA molecule and the second gRNA molecule include targeting domains comprising, e.g., consisting of, SEQ ID NO: 5608 and SEQ ID NO: 5506, respectively. In an aspect, the first gRNA molecule and the second gRNA molecule include targeting domains comprising, e.g., consisting of, SEQ ID NO: 5608 and SEQ ID NO: 5509, respectively. In an aspect, the first gRNA molecule and the second gRNA molecule include targeting domains comprising, e.g., consisting of, SEQ ID NO: 5608 and SEQ ID NO: 5517, respectively. In an aspect, the first gRNA molecule and the second gRNA molecule include targeting domains comprising, e.g., consisting of, SEQ ID NO: 5608 and SEQ ID NO: 5521, respectively. In an aspect, the first gRNA molecule and the second gRNA molecule include targeting domains comprising, e.g., consisting of, SEQ ID NO: 5608 and SEQ ID NO: 5520, respectively. In an aspect, the first gRNA molecule and the second gRNA molecule include targeting domains comprising, e.g., consisting of, SEQ ID NO: 5608 and SEQ ID NO: 5500, respectively. In an aspect, the first gRNA molecule and the second gRNA molecule include targeting domains comprising, e.g., consisting of, SEQ ID NO: 5608 and SEQ ID NO: 5494, respectively. In an aspect, the first gRNA molecule and the second gRNA molecule include targeting domains comprising, e.g., consisting of, SEQ ID NO: 5608 and SEQ ID NO: 5508, respectively. In an aspect, the first gRNA molecule and the second gRNA molecule include targeting domains comprising, e.g., consisting of, SEQ ID NO: 5608 and SEQ ID NO: 5514, respectively. In an aspect, the first gRNA molecule and the second gRNA molecule include targeting domains comprising, e.g., consisting of, SEQ ID NO: 5608 and SEQ ID NO: 5492, respectively. In an aspect, the first gRNA molecule and the second gRNA molecule include targeting domains comprising, e.g., consisting of, SEQ ID NO: 5617 and SEQ ID NO: 5519, respectively. In an aspect, the first gRNA molecule and the second gRNA molecule include targeting domains comprising, e.g., consisting of, SEQ ID NO: 5617 and SEQ ID NO: 5497, respectively. In an aspect, the first gRNA molecule and the second gRNA molecule include targeting domains comprising, e.g., consisting of, SEQ ID NO: 5617 and SEQ ID NO: 5499, respectively. In an aspect, the first gRNA molecule and the second gRNA molecule include targeting domains comprising, e.g., consisting of, SEQ ID NO: 5617 and SEQ ID NO: 5498, respectively. In an aspect, the first gRNA molecule and the second gRNA molecule include targeting domains comprising, e.g., consisting of, SEQ ID NO: 5617 and SEQ ID NO: 5503, respectively. In an aspect, the first gRNA molecule and the second gRNA molecule include targeting domains comprising, e.g., consisting of, SEQ ID NO: 5617 and SEQ ID NO: 5496, respectively. In an aspect, the first gRNA molecule and the second gRNA molecule include targeting domains comprising, e.g., consisting of, SEQ ID NO: 5617 and SEQ ID NO: 5507, respectively. In an aspect, the first gRNA molecule and the second gRNA molecule include targeting domains comprising, e.g., consisting of, SEQ ID NO: 5617 and SEQ ID NO: 5515, respectively. In an aspect, the first gRNA molecule and the second gRNA molecule include targeting domains comprising, e.g., consisting of, SEQ ID NO: 5617 and SEQ ID NO: 5493, respectively. In an aspect, the first gRNA molecule and the second gRNA molecule include targeting domains comprising, e.g., consisting of, SEQ ID NO: 5617 and SEQ ID NO: 5506, respectively. In an aspect, the first gRNA molecule and the second gRNA molecule include targeting domains comprising, e.g., consisting of, SEQ ID NO: 5617 and SEQ ID NO: 5509, respectively. In an aspect, the first gRNA molecule and the second gRNA molecule include targeting domains comprising, e.g., consisting of, SEQ ID NO: 5617 and SEQ ID NO: 5517, respectively. In an aspect, the first gRNA molecule and the second gRNA molecule include targeting domains comprising, e.g., consisting of, SEQ ID NO: 5617 and SEQ ID NO: 5521, respectively. In an aspect, the first gRNA molecule and the second gRNA molecule include targeting domains comprising, e.g., consisting of, SEQ ID NO: 5617 and SEQ ID NO: 5520, respectively. In an aspect, the first gRNA molecule and the second gRNA molecule include targeting domains comprising, e.g., consisting of, SEQ ID NO: 5617 and SEQ ID NO: 5500, respectively. In an aspect, the first gRNA molecule and the second gRNA molecule include targeting domains comprising, e.g., consisting of, SEQ ID NO: 5617 and SEQ ID NO: 5494, respectively. In an aspect, the first gRNA molecule and the second gRNA molecule include targeting domains comprising, e.g., consisting of, SEQ ID NO: 5617 and SEQ ID NO: 5508, respectively. In an aspect, the first gRNA molecule and the second gRNA molecule include targeting domains comprising, e.g., consisting of, SEQ ID NO: 5617 and SEQ ID NO: 5514, respectively. In an aspect, the first gRNA molecule and the second gRNA molecule include targeting domains comprising, e.g., consisting of, SEQ ID NO: 5617 and SEQ ID NO: 5492, respectively. In an aspect, the first gRNA molecule and the second gRNA molecule include targeting domains comprising, e.g., consisting of, SEQ ID NO: 5619 and SEQ ID NO: 5519, respectively. In an aspect, the first gRNA molecule and the second gRNA molecule include targeting domains comprising, e.g., consisting of, SEQ ID NO: 5619 and SEQ ID NO: 5497, respectively. In an aspect, the first gRNA molecule and the second gRNA molecule include targeting domains comprising, e.g., consisting of, SEQ ID NO: 5619 and SEQ ID NO: 5499, respectively. In an aspect, the first gRNA molecule and the second gRNA molecule include targeting domains comprising, e.g., consisting of, SEQ ID NO: 5619 and SEQ ID NO: 5498, respectively. In an aspect, the first gRNA molecule and the second gRNA molecule include targeting domains comprising, e.g., consisting of, SEQ ID NO: 5619 and SEQ ID NO: 5503, respectively. In an aspect, the first gRNA molecule and the second gRNA molecule include targeting domains comprising, e.g., consisting of, SEQ ID NO: 5619 and SEQ ID NO: 5496, respectively. In an aspect, the first gRNA molecule and the second gRNA molecule include targeting domains comprising, e.g., consisting of, SEQ ID NO: 5619 and SEQ ID NO: 5507, respectively. In an aspect, the first gRNA molecule and the second gRNA molecule include targeting domains comprising, e.g., consisting of, SEQ ID NO: 5619 and SEQ ID NO: 5515, respectively. In an aspect, the first gRNA molecule and the second gRNA molecule include targeting domains comprising, e.g., consisting of, SEQ ID NO: 5619 and SEQ ID NO: 5493, respectively. In an aspect, the first gRNA molecule and the second gRNA molecule include targeting domains comprising, e.g., consisting of, SEQ ID NO: 5619 and SEQ ID NO: 5506, respectively. In an aspect, the first gRNA molecule and the second gRNA molecule include targeting domains comprising, e.g., consisting of, SEQ ID NO: 5619 and SEQ ID NO: 5509, respectively. In an aspect, the first gRNA molecule and the second gRNA molecule include targeting domains comprising, e.g., consisting of, SEQ ID NO: 5619 and SEQ ID NO: 5517, respectively. In an aspect, the first gRNA molecule and the second gRNA molecule include targeting domains comprising, e.g., consisting of, SEQ ID NO: 5619 and SEQ ID NO: 5521, respectively. In an aspect, the first gRNA molecule and the second gRNA molecule include targeting domains comprising, e.g., consisting of, SEQ ID NO: 5619 and SEQ ID NO: 5520, respectively. In an aspect, the first gRNA molecule and the second gRNA molecule include targeting domains comprising, e.g., consisting of, SEQ ID NO: 5619 and SEQ ID NO: 5500, respectively. In an aspect, the first gRNA molecule and the second gRNA molecule include targeting domains comprising, e.g., consisting of, SEQ ID NO: 5619 and SEQ ID NO: 5494, respectively. In an aspect, the first gRNA molecule and the second gRNA molecule include targeting domains comprising, e.g., consisting of, SEQ ID NO: 5619 and SEQ ID NO: 5508, respectively. In an aspect, the first gRNA molecule and the second gRNA molecule include targeting domains comprising, e.g., consisting of, SEQ ID NO: 5619 and SEQ ID NO: 5514, respectively. In an aspect, the first gRNA molecule and the second gRNA molecule include targeting domains comprising, e.g., consisting of, SEQ ID NO: 5619 and SEQ ID NO: 5492, respectively. In an aspect, the first gRNA molecule and the second gRNA molecule include targeting domains comprising, e.g., consisting of, SEQ ID NO: 5620 and SEQ ID NO: 5519, respectively. In an aspect, the first gRNA molecule and the second gRNA molecule include targeting domains comprising, e.g., consisting of, SEQ ID NO: 5620 and SEQ ID NO: 5497, respectively. In an aspect, the first gRNA molecule and the second gRNA molecule include targeting domains comprising, e.g., consisting of, SEQ ID NO: 5620 and SEQ ID NO: 5499, respectively. In an aspect, the first gRNA molecule and the second gRNA molecule include targeting domains comprising, e.g., consisting of, SEQ ID NO: 5620 and SEQ ID NO: 5498, respectively. In an aspect, the first gRNA molecule and the second gRNA molecule include targeting domains comprising, e.g., consisting of, SEQ ID NO: 5620 and SEQ ID NO: 5503, respectively. In an aspect, the first gRNA molecule and the second gRNA molecule include targeting domains comprising, e.g., consisting of, SEQ ID NO: 5620 and SEQ ID NO: 5496, respectively. In an aspect, the first gRNA molecule and the second gRNA molecule include targeting domains comprising, e.g., consisting of, SEQ ID NO: 5620 and SEQ ID NO: 5507, respectively. In an aspect, the first gRNA molecule and the second gRNA molecule include targeting domains comprising, e.g., consisting of, SEQ ID NO: 5620 and SEQ ID NO: 5515, respectively. In an aspect, the first gRNA molecule and the second gRNA molecule include targeting domains comprising, e.g., consisting of, SEQ ID NO: 5620 and SEQ ID NO: 5493, respectively. In an aspect, the first gRNA molecule and the second gRNA molecule include targeting domains comprising, e.g., consisting of, SEQ ID NO: 5620 and SEQ ID NO: 5506, respectively. In an aspect, the first gRNA molecule and the second gRNA molecule include targeting domains comprising, e.g., consisting of, SEQ ID NO: 5620 and SEQ ID NO: 5509, respectively. In an aspect, the first gRNA molecule and the second gRNA molecule include targeting domains comprising, e.g., consisting of, SEQ ID NO: 5620 and SEQ ID NO: 5517, respectively. In an aspect, the first gRNA molecule and the second gRNA molecule include targeting domains comprising, e.g., consisting of, SEQ ID NO: 5620 and SEQ ID NO: 5521, respectively. In an aspect, the first gRNA molecule and the second gRNA molecule include targeting domains comprising, e.g., consisting of, SEQ ID NO: 5620 and SEQ ID NO: 5520, respectively. In an aspect, the first gRNA molecule and the second gRNA molecule include targeting domains comprising, e.g., consisting of, SEQ ID NO: 5620 and SEQ ID NO: 5500, respectively. In an aspect, the first gRNA molecule and the second gRNA molecule include targeting domains comprising, e.g., consisting of, SEQ ID NO: 5620 and SEQ ID NO: 5494, respectively. In an aspect, the first gRNA molecule and the second gRNA molecule include targeting domains comprising, e.g., consisting of, SEQ ID NO: 5620 and SEQ ID NO: 5508, respectively. In an aspect, the first gRNA molecule and the second gRNA molecule include targeting domains comprising, e.g., consisting of, SEQ ID NO: 5620 and SEQ ID NO: 5514, respectively. In an aspect, the first gRNA molecule and the second gRNA molecule include targeting domains comprising, e.g., consisting of, SEQ ID NO: 5620 and SEQ ID NO: 5492, respectively. In any of the aforementioned combinations, the aspect or the embodiment of the invention may additionally include a third gRNA molecule (or more than one gRNA molecules)

comprising a targeting domain specific for a sequence of CIITA, e.g. as described herein, e.g., as described herein in Table 6c.

In aspects of the invention that utilize two or more, e.g., two, gRNA molecules, it may be particularly useful for a first gRNA molecule to comprise a targeting domain specific for a sequence of TRBC (e.g., TRBC1 or TRBC2) and a second gRNA molecule to comprise a targeting domain specific for a sequence of B2M. In such aspects, it is particularly preferred that the first gRNA molecule to TRBC comprises a targeting domain of any gRNA molecule of FIG. 13, and the second gRNA molecule to B2M comprises a targeting domain of any gRNA molecule of FIG. 14. In an aspect, the first gRNA molecule and the second gRNA molecule include targeting domains comprising, e.g., consisting of, SEQ ID NO: 5719 and SEQ ID NO: 5519, respectively. In an aspect, the first gRNA molecule and the second gRNA molecule include targeting domains comprising, e.g., consisting of, SEQ ID NO: 5719 and SEQ ID NO: 5497, respectively. In an aspect, the first gRNA molecule and the second gRNA molecule include targeting domains comprising, e.g., consisting of, SEQ ID NO: 5719 and SEQ ID NO: 5499, respectively. In an aspect, the first gRNA molecule and the second gRNA molecule include targeting domains comprising, e.g., consisting of, SEQ ID NO: 5719 and SEQ ID NO: 5498, respectively. In an aspect, the first gRNA molecule and the second gRNA molecule include targeting domains comprising, e.g., consisting of, SEQ ID NO: 5719 and SEQ ID NO: 5503, respectively. In an aspect, the first gRNA molecule and the second gRNA molecule include targeting domains comprising, e.g., consisting of, SEQ ID NO: 5719 and SEQ ID NO: 5496, respectively. In an aspect, the first gRNA molecule and the second gRNA molecule include targeting domains comprising, e.g., consisting of, SEQ ID NO: 5719 and SEQ ID NO: 5507, respectively. In an aspect, the first gRNA molecule and the second gRNA molecule include targeting domains comprising, e.g., consisting of, SEQ ID NO: 5719 and SEQ ID NO: 5515, respectively. In an aspect, the first gRNA molecule and the second gRNA molecule include targeting domains comprising, e.g., consisting of, SEQ ID NO: 5719 and SEQ ID NO: 5493, respectively. In an aspect, the first gRNA molecule and the second gRNA molecule include targeting domains comprising, e.g., consisting of, SEQ ID NO: 5719 and SEQ ID NO: 5506, respectively. In an aspect, the first gRNA molecule and the second gRNA molecule include targeting domains comprising, e.g., consisting of, SEQ ID NO: 5719 and SEQ ID NO: 5509, respectively. In an aspect, the first gRNA molecule and the second gRNA molecule include targeting domains comprising, e.g., consisting of, SEQ ID NO: 5719 and SEQ ID NO: 5517, respectively. In an aspect, the first gRNA molecule and the second gRNA molecule include targeting domains comprising, e.g., consisting of, SEQ ID NO: 5719 and SEQ ID NO: 5521, respectively. In an aspect, the first gRNA molecule and the second gRNA molecule include targeting domains comprising, e.g., consisting of, SEQ ID NO: 5719 and SEQ ID NO: 5520, respectively. In an aspect, the first gRNA molecule and the second gRNA molecule include targeting domains comprising, e.g., consisting of, SEQ ID NO: 5719 and SEQ ID NO: 5500, respectively. In an aspect, the first gRNA molecule and the second gRNA molecule include targeting domains comprising, e.g., consisting of, SEQ ID NO: 5719 and SEQ ID NO: 5494, respectively. In an aspect, the first gRNA molecule and the second gRNA molecule include targeting domains comprising, e.g., consisting of, SEQ ID NO: 5719 and SEQ ID NO: 5508, respectively. In an aspect, the first gRNA molecule and the second gRNA molecule include targeting domains comprising, e.g., consisting of, SEQ ID NO: 5719 and SEQ ID NO: 5514, respectively. In an aspect, the first gRNA molecule and the second gRNA molecule include targeting domains comprising, e.g., consisting of, SEQ ID NO: 5719 and SEQ ID NO: 5492, respectively. In an aspect, the first gRNA molecule and the second gRNA molecule include targeting domains comprising, e.g., consisting of, SEQ ID NO: 5694 and SEQ ID NO: 5519, respectively. In an aspect, the first gRNA molecule and the second gRNA molecule include targeting domains comprising, e.g., consisting of, SEQ ID NO: 5694 and SEQ ID NO: 5497, respectively. In an aspect, the first gRNA molecule and the second gRNA molecule include targeting domains comprising, e.g., consisting of, SEQ ID NO: 5694 and SEQ ID NO: 5499, respectively. In an aspect, the first gRNA molecule and the second gRNA molecule include targeting domains comprising, e.g., consisting of, SEQ ID NO: 5694 and SEQ ID NO: 5498, respectively. In an aspect, the first gRNA molecule and the second gRNA molecule include targeting domains comprising, e.g., consisting of, SEQ ID NO: 5694 and SEQ ID NO: 5503, respectively. In an aspect, the first gRNA molecule and the second gRNA molecule include targeting domains comprising, e.g., consisting of, SEQ ID NO: 5694 and SEQ ID NO: 5496, respectively. In an aspect, the first gRNA molecule and the second gRNA molecule include targeting domains comprising, e.g., consisting of, SEQ ID NO: 5694 and SEQ ID NO: 5507, respectively. In an aspect, the first gRNA molecule and the second gRNA molecule include targeting domains comprising, e.g., consisting of, SEQ ID NO: 5694 and SEQ ID NO: 5515, respectively. In an aspect, the first gRNA molecule and the second gRNA molecule include targeting domains comprising, e.g., consisting of, SEQ ID NO: 5694 and SEQ ID NO: 5493, respectively. In an aspect, the first gRNA molecule and the second gRNA molecule include targeting domains comprising, e.g., consisting of, SEQ ID NO: 5694 and SEQ ID NO: 5506, respectively. In an aspect, the first gRNA molecule and the second gRNA molecule include targeting domains comprising, e.g., consisting of, SEQ ID NO: 5694 and SEQ ID NO: 5509, respectively. In an aspect, the first gRNA molecule and the second gRNA molecule include targeting domains comprising, e.g., consisting of, SEQ ID NO: 5694 and SEQ ID NO: 5517, respectively. In an aspect, the first gRNA molecule and the second gRNA molecule include targeting domains comprising, e.g., consisting of, SEQ ID NO: 5694 and SEQ ID NO: 5521, respectively. In an aspect, the first gRNA molecule and the second gRNA molecule include targeting domains comprising, e.g., consisting of, SEQ ID NO: 5694 and SEQ ID NO: 5520, respectively. In an aspect, the first gRNA molecule and the second gRNA molecule include targeting domains comprising, e.g., consisting of, SEQ ID NO: 5694 and SEQ ID NO: 5500, respectively. In an aspect, the first gRNA molecule and the second gRNA molecule include targeting domains comprising, e.g., consisting of, SEQ ID NO: 5694 and SEQ ID NO: 5494, respectively. In an aspect, the first gRNA molecule and the second gRNA molecule include targeting domains comprising, e.g., consisting of, SEQ ID NO: 5694 and SEQ ID NO: 5508, respectively. In an aspect, the first gRNA molecule and the second gRNA molecule include targeting domains comprising, e.g., consisting of, SEQ ID NO: 5694 and SEQ ID NO: 5514, respectively. In an aspect, the first gRNA molecule and the second gRNA molecule include targeting domains comprising, e.g., consisting of, SEQ ID NO: 5694 and SEQ ID NO: 5492, respectively. In an aspect, the first gRNA molecule and the second gRNA molecule include targeting domains comprising, e.g., consisting of, SEQ ID NO: 5706 and SEQ ID NO: 5519, respectively. In an aspect, the first gRNA molecule and the second gRNA molecule include targeting domains comprising, e.g., consisting of, SEQ ID NO: 5706 and SEQ ID NO: 5497, respectively. In an aspect, the first gRNA molecule and the second gRNA molecule include targeting domains comprising, e.g., consisting of, SEQ ID NO: 5706 and SEQ ID NO: 5499, respectively. In an aspect, the first gRNA molecule and the second gRNA molecule include targeting domains comprising, e.g., consisting of, SEQ ID NO: 5706 and SEQ ID NO: 5498, respectively. In an aspect, the first gRNA molecule and the second gRNA molecule include targeting domains comprising, e.g., consisting of, SEQ ID NO: 5706 and SEQ ID NO: 5503, respectively. In an aspect, the first gRNA molecule and the second gRNA molecule include targeting domains comprising, e.g., consisting of, SEQ ID NO: 5706 and SEQ ID NO: 5496, respectively. In an aspect, the first gRNA molecule and the second gRNA molecule include targeting domains comprising, e.g., consisting of, SEQ ID NO: 5706 and SEQ ID NO: 5507, respectively. In an aspect, the first gRNA molecule and the second gRNA molecule include targeting domains comprising, e.g., consisting of, SEQ ID NO: 5706 and SEQ ID NO: 5515, respectively. In an aspect, the first gRNA molecule and the second gRNA molecule include targeting domains comprising, e.g., consisting of, SEQ ID NO: 5706 and SEQ ID NO: 5493, respectively. In an aspect, the first gRNA molecule and the second gRNA molecule include targeting domains comprising, e.g., consisting of, SEQ ID NO: 5706 and SEQ ID NO: 5506, respectively. In an aspect, the first gRNA molecule and the second gRNA molecule include targeting domains comprising, e.g., consisting of, SEQ ID NO: 5706 and SEQ ID NO: 5509, respectively. In an aspect, the first gRNA molecule and the second gRNA molecule include targeting domains comprising, e.g., consisting of, SEQ ID NO: 5706 and SEQ ID NO: 5517, respectively. In an aspect, the first gRNA molecule and the second gRNA molecule include targeting domains comprising, e.g., consisting of, SEQ ID NO: 5706 and SEQ ID NO: 5521, respectively. In an aspect, the first gRNA molecule and the second gRNA molecule include targeting domains comprising, e.g., consisting of, SEQ ID NO: 5706 and SEQ ID NO: 5520, respectively. In an aspect, the first gRNA molecule and the second gRNA molecule include targeting domains comprising, e.g., consisting of, SEQ ID NO: 5706 and SEQ ID NO: 5500, respectively. In an aspect, the first gRNA molecule and the second gRNA molecule include targeting domains comprising, e.g., consisting of, SEQ ID NO: 5706 and SEQ ID NO: 5494, respectively. In an aspect, the first gRNA molecule and the second gRNA molecule include targeting domains comprising, e.g., consisting of, SEQ ID NO: 5706 and SEQ ID NO: 5508, respectively. In an aspect, the first gRNA molecule and the second gRNA molecule include targeting domains comprising, e.g., consisting of, SEQ ID NO: 5706 and SEQ ID NO: 5514, respectively. In an aspect, the first gRNA molecule and the second gRNA molecule include targeting domains comprising, e.g., consisting of, SEQ ID NO: 5706 and SEQ ID NO: 5492, respectively. In an aspect, the first gRNA molecule and the second gRNA molecule include targeting domains comprising, e.g., consisting of, SEQ ID NO: 5696 and SEQ ID NO: 5519, respectively. In an aspect, the first gRNA molecule and the second gRNA molecule include targeting domains comprising, e.g., consisting of, SEQ ID NO: 5696 and SEQ ID NO: 5497, respectively. In an aspect, the first gRNA molecule and the second gRNA molecule include targeting domains comprising, e.g., consisting of, SEQ ID NO: 5696 and SEQ ID NO: 5499, respectively. In an aspect, the first gRNA molecule and the second gRNA molecule include targeting domains comprising, e.g., consisting of, SEQ ID NO: 5696 and SEQ ID NO: 5498, respectively. In an aspect, the first gRNA molecule and the second gRNA molecule include targeting domains comprising, e.g., consisting of, SEQ ID NO: 5696 and SEQ ID NO: 5503, respectively. In an aspect, the first gRNA molecule and the second gRNA molecule include targeting domains comprising, e.g., consisting of, SEQ ID NO: 5696 and SEQ ID NO: 5496, respectively. In an aspect, the first gRNA molecule and the second gRNA molecule include targeting domains comprising, e.g., consisting of, SEQ ID NO: 5696 and SEQ ID NO: 5507, respectively. In an aspect, the first gRNA molecule and the second gRNA molecule include targeting domains comprising, e.g., consisting of, SEQ ID NO: 5696 and SEQ ID NO: 5515, respectively. In an aspect, the first gRNA molecule and the second gRNA molecule include targeting domains comprising, e.g., consisting of, SEQ ID NO: 5696 and SEQ ID NO: 5493, respectively. In an aspect, the first gRNA molecule and the second gRNA molecule include targeting domains comprising, e.g., consisting of, SEQ ID NO: 5696 and SEQ ID NO: 5506, respectively. In an aspect, the first gRNA molecule and the second gRNA molecule include targeting domains comprising, e.g., consisting of, SEQ ID NO: 5696 and SEQ ID NO: 5509, respectively. In an aspect, the first gRNA molecule and the second gRNA molecule include targeting domains comprising, e.g., consisting of, SEQ ID NO: 5696 and SEQ ID NO: 5517, respectively. In an aspect, the first gRNA molecule and the second gRNA molecule include targeting domains comprising, e.g., consisting of, SEQ ID NO: 5696 and SEQ ID NO: 5521, respectively. In an aspect, the first gRNA molecule and the second gRNA molecule include targeting domains comprising, e.g., consisting of, SEQ ID NO: 5696 and SEQ ID NO: 5520, respectively. In an aspect, the first gRNA molecule and the second gRNA molecule include targeting domains comprising, e.g., consisting of, SEQ ID NO: 5696 and SEQ ID NO: 5500, respectively. In an aspect, the first gRNA molecule and the second gRNA molecule include targeting domains comprising, e.g., consisting of, SEQ ID NO: 5696 and SEQ ID NO: 5494, respectively. In an aspect, the first gRNA molecule and the second gRNA molecule include targeting domains comprising, e.g., consisting of, SEQ ID NO: 5696 and SEQ ID NO: 5508, respectively. In an aspect, the first gRNA molecule and the second gRNA molecule include targeting domains comprising, e.g., consisting of, SEQ ID NO: 5696 and SEQ ID NO: 5514, respectively. In an aspect, the first gRNA molecule and the second gRNA molecule include targeting domains comprising, e.g., consisting of, SEQ ID NO: 5696 and SEQ ID NO: 5492, respectively. In an aspect, the first gRNA molecule and the second gRNA molecule include targeting domains comprising, e.g., consisting of, SEQ ID NO: 5711 and SEQ ID NO: 5519, respectively. In an aspect, the first gRNA molecule and the second gRNA molecule include targeting domains comprising, e.g., consisting of, SEQ ID NO: 5711 and SEQ ID NO: 5497, respectively. In an aspect, the first gRNA molecule and the second gRNA molecule include targeting domains comprising, e.g., consisting of, SEQ ID NO: 5711 and SEQ ID NO: 5499, respectively. In an aspect, the first gRNA molecule and the second gRNA molecule include targeting domains comprising, e.g., consisting of, SEQ ID NO: 5711 and SEQ ID NO: 5498, respectively. In an aspect, the first gRNA molecule and the second gRNA molecule include targeting domains comprising, e.g., consisting of, SEQ ID NO: 5711 and SEQ ID NO: 5503, respectively. In an aspect, the first gRNA molecule and the second gRNA molecule include targeting domains comprising, e.g., consisting of, SEQ ID NO: 5711 and SEQ ID NO: 5496, respectively. In an aspect, the first gRNA molecule and the second gRNA molecule include targeting domains comprising, e.g., consisting of, SEQ ID NO: 5711 and SEQ ID NO: 5507, respectively. In an aspect, the first gRNA molecule and the second gRNA molecule include targeting domains comprising, e.g., consisting of, SEQ ID NO: 5711 and SEQ ID NO: 5515, respectively. In an aspect, the first gRNA molecule and the second gRNA molecule include targeting domains comprising, e.g., consisting of, SEQ ID NO: 5711 and SEQ ID NO: 5493, respectively. In an aspect, the first gRNA molecule and the second gRNA molecule include targeting domains comprising, e.g., consisting of, SEQ ID NO: 5711 and SEQ ID NO: 5506, respectively. In an aspect, the first gRNA molecule and the second gRNA molecule include targeting domains comprising, e.g., consisting of, SEQ ID NO: 5711 and SEQ ID NO: 5509, respectively. In an aspect, the first gRNA molecule and the second gRNA molecule include targeting domains comprising, e.g., consisting of, SEQ ID NO: 5711 and SEQ ID NO: 5517, respectively. In an aspect, the first gRNA molecule and the second gRNA molecule include targeting domains comprising, e.g., consisting of, SEQ ID NO: 5711 and SEQ ID NO: 5521, respectively. In an aspect, the first gRNA molecule and the second gRNA molecule include targeting domains comprising, e.g., consisting of, SEQ ID NO: 5711 and SEQ ID NO: 5520, respectively. In an aspect, the first gRNA molecule and the second gRNA molecule include targeting domains comprising, e.g., consisting of, SEQ ID NO: 5711 and SEQ ID NO: 5500, respectively. In an aspect, the first gRNA molecule and the second gRNA molecule include targeting domains comprising, e.g., consisting of, SEQ ID NO: 5711 and SEQ ID NO: 5494, respectively. In an aspect, the first gRNA molecule and the second gRNA molecule include targeting domains comprising, e.g., consisting of, SEQ ID NO: 5711 and SEQ ID NO: 5508, respectively. In an aspect, the first gRNA molecule and the second gRNA molecule include targeting domains comprising, e.g., consisting of, SEQ ID NO: 5711 and SEQ ID NO: 5514, respectively. In an aspect, the first gRNA molecule and the second gRNA molecule include targeting domains comprising, e.g., consisting of, SEQ ID NO: 5711 and SEQ ID NO: 5492, respectively. In an aspect, the first gRNA molecule and the second gRNA molecule include targeting domains comprising, e.g., consisting of, SEQ ID NO: 5708 and SEQ ID NO: 5519, respectively. In an aspect, the first gRNA molecule and the second gRNA molecule include targeting domains comprising, e.g., consisting of, SEQ ID NO: 5708 and SEQ ID NO: 5497, respectively. In an aspect, the first gRNA molecule and the second gRNA molecule include targeting domains comprising, e.g., consisting of, SEQ ID NO: 5708 and SEQ ID NO: 5499, respectively. In an aspect, the first gRNA molecule and the second gRNA molecule include targeting domains comprising, e.g., consisting of, SEQ ID NO: 5708 and SEQ ID NO: 5498, respectively. In an aspect, the first gRNA molecule and the second gRNA molecule include targeting domains comprising, e.g., consisting of, SEQ ID NO: 5708 and SEQ ID NO: 5503, respectively. In an aspect, the first gRNA molecule and the second gRNA molecule include targeting domains comprising, e.g., consisting of, SEQ ID NO: 5708 and SEQ ID NO: 5496, respectively. In an aspect, the first gRNA molecule and the second gRNA molecule include targeting domains comprising, e.g., consisting of, SEQ ID NO: 5708 and SEQ ID NO: 5507, respectively. In an aspect, the first gRNA molecule and the second gRNA molecule include targeting domains comprising, e.g., consisting of, SEQ ID NO: 5708 and SEQ ID NO: 5515, respectively. In an aspect, the first gRNA molecule and the second gRNA molecule include targeting domains comprising, e.g., consisting of, SEQ ID NO: 5708 and SEQ ID NO: 5493, respectively. In an aspect, the first gRNA molecule and the second gRNA molecule include targeting domains comprising, e.g., consisting of, SEQ ID NO: 5708 and SEQ ID NO: 5506, respectively. In an aspect, the first gRNA molecule and the second gRNA molecule include targeting domains comprising, e.g., consisting of, SEQ ID NO: 5708 and SEQ ID NO: 5509, respectively. In an aspect, the first gRNA molecule and the second gRNA molecule include targeting domains comprising, e.g., consisting of, SEQ ID NO: 5708 and SEQ ID NO: 5517, respectively. In an aspect, the first gRNA molecule and the second gRNA molecule include targeting domains comprising, e.g., consisting of, SEQ ID NO: 5708 and SEQ ID NO: 5521, respectively. In an aspect, the first gRNA molecule and the second gRNA molecule include targeting domains comprising, e.g., consisting of, SEQ ID NO: 5708 and SEQ ID NO: 5520, respectively. In an aspect, the first gRNA molecule and the second gRNA molecule include targeting domains comprising, e.g., consisting of, SEQ ID NO: 5708 and SEQ ID NO: 5500, respectively. In an aspect, the first gRNA molecule and the second gRNA molecule include targeting domains comprising, e.g., consisting of, SEQ ID NO: 5708 and SEQ ID NO: 5494, respectively. In an aspect, the first gRNA molecule and the second gRNA molecule include targeting domains comprising, e.g., consisting of, SEQ ID NO: 5708 and SEQ ID NO: 5508, respectively. In an aspect, the first gRNA molecule and the second gRNA molecule include targeting domains comprising, e.g., consisting of, SEQ ID NO: 5708 and SEQ ID NO: 5514, respectively. In an aspect, the first gRNA molecule and the second gRNA molecule include targeting domains comprising, e.g., consisting of, SEQ ID NO: 5708 and SEQ ID NO: 5492, respectively. In an aspect, the first gRNA molecule and the second gRNA molecule include targeting domains comprising, e.g., consisting of, SEQ ID NO: 5709 and SEQ ID NO: 5519, respectively. In an aspect, the first gRNA molecule and the second gRNA molecule include targeting domains comprising, e.g., consisting of, SEQ ID NO: 5709 and SEQ ID NO: 5497, respectively. In an aspect, the first gRNA molecule and the second gRNA molecule include targeting domains comprising, e.g., consisting of, SEQ ID NO: 5709 and SEQ ID NO: 5499, respectively. In an aspect, the first gRNA molecule and the second gRNA molecule include targeting domains comprising, e.g., consisting of, SEQ ID NO: 5709 and SEQ ID NO: 5498, respectively. In an aspect, the first gRNA molecule and the second gRNA molecule include targeting domains comprising, e.g., consisting of, SEQ ID NO: 5709 and SEQ ID NO: 5503, respectively. In an aspect, the first gRNA molecule and the second gRNA molecule include targeting domains comprising, e.g., consisting of, SEQ ID NO: 5709 and SEQ ID NO: 5496, respectively. In an aspect, the first gRNA molecule and the second gRNA molecule include targeting domains comprising, e.g., consisting of, SEQ ID NO: 5709 and SEQ ID NO: 5507, respectively. In an aspect, the first gRNA molecule and the second gRNA molecule include targeting domains comprising, e.g., consisting of, SEQ ID NO: 5709 and SEQ ID NO: 5515, respectively. In an aspect, the first gRNA molecule and the second gRNA molecule include targeting domains comprising, e.g., consisting of, SEQ ID NO: 5709 and SEQ ID NO: 5493, respectively. In an aspect, the first gRNA molecule and the second gRNA molecule include targeting domains comprising, e.g., consisting of, SEQ ID NO: 5709 and SEQ ID NO: 5506, respectively. In an aspect, the first gRNA molecule and the second gRNA molecule include targeting domains comprising, e.g., consisting of, SEQ ID NO: 5709 and SEQ ID NO: 5509, respectively. In an aspect, the first gRNA molecule and the second gRNA molecule include targeting domains comprising, e.g., consisting of, SEQ ID NO: 5709 and SEQ ID NO: 5517, respectively. In an aspect, the first gRNA molecule and the second gRNA molecule include targeting domains comprising, e.g., consisting of, SEQ ID NO: 5709 and SEQ ID NO: 5521, respectively. In an aspect, the first gRNA molecule and the second gRNA molecule include targeting domains comprising, e.g., consisting of, SEQ ID NO: 5709 and SEQ ID NO: 5520, respectively. In an aspect, the first gRNA molecule and the second gRNA molecule include targeting domains comprising, e.g., consisting of, SEQ ID NO: 5709 and SEQ ID NO: 5500, respectively. In an aspect, the first gRNA molecule and the second gRNA molecule include targeting domains comprising, e.g., consisting of, SEQ ID NO: 5709 and SEQ ID NO: 5494, respectively. In an aspect, the first gRNA molecule and the second gRNA molecule include targeting domains comprising, e.g., consisting of, SEQ ID NO: 5709 and SEQ ID NO: 5508, respectively. In an aspect, the first gRNA molecule and the second gRNA molecule include targeting domains comprising, e.g., consisting of, SEQ ID NO: 5709 and SEQ ID NO: 5514, respectively. In an aspect, the first gRNA molecule and the second gRNA molecule include targeting domains comprising, e.g., consisting of, SEQ ID NO: 5709 and SEQ ID NO: 5492, respectively. In an aspect, the first gRNA molecule and the second gRNA molecule include targeting domains comprising, e.g., consisting of, SEQ ID NO: 5712 and SEQ ID NO: 5519, respectively. In an aspect, the first gRNA molecule and the second gRNA molecule include targeting domains comprising, e.g., consisting of, SEQ ID NO: 5712 and SEQ ID NO: 5497, respectively. In an aspect, the first gRNA molecule and the second gRNA molecule include targeting domains comprising, e.g., consisting of, SEQ ID NO: 5712 and SEQ ID NO: 5499, respectively. In an aspect, the first gRNA molecule and the second gRNA molecule include targeting domains comprising, e.g., consisting of, SEQ ID NO: 5712 and SEQ ID NO: 5498, respectively. In an aspect, the first gRNA molecule and the second gRNA molecule include targeting domains comprising, e.g., consisting of, SEQ ID NO: 5712 and SEQ ID NO: 5503, respectively. In an aspect, the first gRNA molecule and the second gRNA molecule include targeting domains comprising, e.g., consisting of, SEQ ID NO: 5712 and SEQ ID NO: 5496, respectively. In an aspect, the first gRNA molecule and the second gRNA molecule include targeting domains comprising, e.g., consisting of, SEQ ID NO: 5712 and SEQ ID NO: 5507, respectively. In an aspect, the first gRNA molecule and the second gRNA molecule include targeting domains comprising, e.g., consisting of, SEQ ID NO: 5712 and SEQ ID NO: 5515, respectively. In an aspect, the first gRNA molecule and the second gRNA molecule include targeting domains comprising, e.g., consisting of, SEQ ID NO: 5712 and SEQ ID NO: 5493, respectively. In an aspect, the first gRNA molecule and the second gRNA molecule include targeting domains comprising, e.g., consisting of, SEQ ID NO: 5712 and SEQ ID NO: 5506, respectively. In an aspect, the first gRNA molecule and the second gRNA molecule include targeting domains comprising, e.g., consisting of, SEQ ID NO: 5712 and SEQ ID NO: 5509, respectively. In an aspect, the first gRNA molecule and the second gRNA molecule include targeting domains comprising, e.g., consisting of, SEQ ID NO: 5712 and SEQ ID NO: 5517, respectively. In an aspect, the first gRNA molecule and the second gRNA molecule include targeting domains comprising, e.g., consisting of, SEQ ID NO: 5712 and SEQ ID NO: 5521, respectively. In an aspect, the first gRNA molecule and the second gRNA molecule include targeting domains comprising, e.g., consisting of, SEQ ID NO: 5712 and SEQ ID NO: 5520, respectively. In an aspect, the first gRNA molecule and the second gRNA molecule include targeting domains comprising, e.g., consisting of, SEQ ID NO: 5712 and SEQ ID NO: 5500, respectively. In an aspect, the first gRNA molecule and the second gRNA molecule include targeting domains comprising, e.g., consisting of, SEQ ID NO: 5712 and SEQ ID NO: 5494, respectively. In an aspect, the first gRNA molecule and the second gRNA molecule include targeting domains comprising, e.g., consisting of, SEQ ID NO: 5712 and SEQ ID NO: 5508, respectively. In an aspect, the first gRNA molecule and the second gRNA molecule include targeting domains comprising, e.g., consisting of, SEQ ID NO: 5712 and SEQ ID NO: 5514, respectively. In an aspect, the first gRNA molecule and the second gRNA molecule include targeting domains comprising, e.g., consisting of, SEQ ID NO: 5712 and SEQ ID NO: 5492, respectively. In an aspect, the first gRNA molecule and the second gRNA molecule include targeting domains comprising, e.g., consisting of, SEQ ID NO: 5703 and SEQ ID NO: 5519, respectively. In an aspect, the first gRNA molecule and the second gRNA molecule include targeting domains comprising, e.g., consisting of, SEQ ID NO: 5703 and SEQ ID NO: 5497, respectively. In an aspect, the first gRNA molecule and the second gRNA molecule include targeting domains comprising, e.g., consisting of, SEQ ID NO: 5703 and SEQ ID NO: 5499, respectively. In an aspect, the first gRNA molecule and the second gRNA molecule include targeting domains comprising, e.g., consisting of, SEQ ID NO: 5703 and SEQ ID NO: 5498, respectively. In an aspect, the first gRNA molecule and the second gRNA molecule include targeting domains comprising, e.g., consisting of, SEQ ID NO: 5703 and SEQ ID NO: 5503, respectively. In an aspect, the first gRNA molecule and the second gRNA molecule include targeting domains comprising, e.g., consisting of, SEQ ID NO: 5703 and SEQ ID NO: 5496, respectively. In an aspect, the first gRNA molecule and the second gRNA molecule include targeting domains comprising, e.g., consisting of, SEQ ID NO: 5703 and SEQ ID NO: 5507, respectively. In an aspect, the first gRNA molecule and the second gRNA molecule include targeting domains comprising, e.g., consisting of, SEQ ID NO: 5703 and SEQ ID NO: 5515, respectively. In an aspect, the first gRNA molecule and the second gRNA molecule include targeting domains comprising, e.g., consisting of, SEQ ID NO: 5703 and SEQ ID NO: 5493, respectively. In an aspect, the first gRNA molecule and the second gRNA molecule include targeting domains comprising, e.g., consisting of, SEQ ID NO: 5703 and SEQ ID NO: 5506, respectively. In an aspect, the first gRNA molecule and the second gRNA molecule include targeting domains comprising, e.g., consisting of, SEQ ID NO: 5703 and SEQ ID NO: 5509, respectively. In an aspect, the first gRNA molecule and the second gRNA molecule include targeting domains comprising, e.g., consisting of, SEQ ID NO: 5703 and SEQ ID NO: 5517, respectively. In an aspect, the first gRNA molecule and the second gRNA molecule include targeting domains comprising, e.g., consisting of, SEQ ID NO: 5703 and SEQ ID NO: 5521, respectively. In an aspect, the first gRNA molecule and the second gRNA molecule include targeting domains comprising, e.g., consisting of, SEQ ID NO: 5703 and SEQ ID NO: 5520, respectively. In an aspect, the first gRNA molecule and the second gRNA molecule include targeting domains comprising, e.g., consisting of, SEQ ID NO: 5703 and SEQ ID NO: 5500, respectively. In an aspect, the first gRNA molecule and the second gRNA molecule include targeting domains comprising, e.g., consisting of, SEQ ID NO: 5703 and SEQ ID NO: 5494, respectively. In an aspect, the first gRNA molecule and the second gRNA molecule include targeting domains comprising, e.g., consisting of, SEQ ID NO: 5703 and SEQ ID NO: 5508, respectively. In an aspect, the first gRNA molecule and the second gRNA molecule include targeting domains comprising, e.g., consisting of, SEQ ID NO: 5703 and SEQ ID NO: 5514, respectively. In an aspect, the first gRNA molecule and the second gRNA molecule include targeting domains comprising, e.g., consisting of, SEQ ID NO: 5703 and SEQ ID NO: 5492, respectively. In an aspect, the first gRNA molecule and the second gRNA molecule include targeting domains comprising, e.g., consisting of, SEQ ID NO: 5707 and SEQ ID NO: 5519, respectively. In an aspect, the first gRNA molecule and the second gRNA molecule include targeting domains comprising, e.g., consisting of, SEQ ID NO: 5707 and SEQ ID NO: 5497, respectively. In an aspect, the first gRNA molecule and the second gRNA molecule include targeting domains comprising, e.g., consisting of, SEQ ID NO: 5707 and SEQ ID NO: 5499, respectively. In an aspect, the first gRNA molecule and the second gRNA molecule include targeting domains comprising, e.g., consisting of, SEQ ID NO: 5707 and SEQ ID NO: 5498, respectively. In an aspect, the first gRNA molecule and the second gRNA molecule include targeting domains comprising, e.g., consisting of, SEQ ID NO: 5707 and SEQ ID NO: 5503, respectively. In an aspect, the first gRNA molecule and the second gRNA molecule include targeting domains comprising, e.g., consisting of, SEQ ID NO: 5707 and SEQ ID NO: 5496, respectively. In an aspect, the first gRNA molecule and the second gRNA molecule include targeting domains comprising, e.g., consisting of, SEQ ID NO: 5707 and SEQ ID NO: 5507, respectively. In an aspect, the first gRNA molecule and the second gRNA molecule include targeting domains comprising, e.g., consisting of, SEQ ID NO: 5707 and SEQ ID NO: 5515, respectively. In an aspect, the first gRNA molecule and the second gRNA molecule include targeting domains comprising, e.g., consisting of, SEQ ID NO: 5707 and SEQ ID NO: 5493, respectively. In an aspect, the first gRNA molecule and the second gRNA molecule include targeting domains comprising, e.g., consisting of, SEQ ID NO: 5707 and SEQ ID NO: 5506, respectively. In an aspect, the first gRNA molecule and the second gRNA molecule include targeting domains comprising, e.g., consisting of, SEQ ID NO: 5707 and SEQ ID NO: 5509, respectively. In an aspect, the first gRNA molecule and the second gRNA molecule include targeting domains comprising, e.g., consisting of, SEQ ID NO: 5707 and SEQ ID NO: 5517, respectively. In an aspect, the first gRNA molecule and the second gRNA molecule include targeting domains comprising, e.g., consisting of, SEQ ID NO: 5707 and SEQ ID NO: 5521, respectively. In an aspect, the first gRNA molecule and the second gRNA molecule include targeting domains comprising, e.g., consisting of, SEQ ID NO: 5707 and SEQ ID NO: 5520, respectively. In an aspect, the first gRNA molecule and the second gRNA molecule include targeting domains comprising, e.g., consisting of, SEQ ID NO: 5707 and SEQ ID NO: 5500, respectively. In an aspect, the first gRNA molecule and the second gRNA molecule include targeting domains comprising, e.g., consisting of, SEQ ID NO: 5707 and SEQ ID NO: 5494, respectively. In an aspect, the first gRNA molecule and the second gRNA molecule include targeting domains comprising, e.g., consisting of, SEQ ID NO: 5707 and SEQ ID NO: 5508, respectively. In an aspect, the first gRNA molecule and the second gRNA molecule include targeting domains comprising, e.g., consisting of, SEQ ID NO: 5707 and SEQ ID NO: 5514, respectively. In an aspect, the first gRNA molecule and the second gRNA molecule include targeting domains comprising, e.g., consisting of, SEQ ID NO: 5707 and SEQ ID NO: 5492, respectively. In an aspect, the first gRNA molecule and the second gRNA molecule include targeting domains comprising, e.g., consisting of, SEQ ID NO: 5687 and SEQ ID NO: 5519, respectively. In an aspect, the first gRNA molecule and the second gRNA molecule include targeting domains comprising, e.g., consisting of, SEQ ID NO: 5687 and SEQ ID NO: 5497, respectively. In an aspect, the first gRNA molecule and the second gRNA molecule include targeting domains comprising, e.g., consisting of, SEQ ID NO: 5687 and SEQ ID NO: 5499, respectively. In an aspect, the first gRNA molecule and the second gRNA molecule include targeting domains comprising, e.g., consisting of, SEQ ID NO: 5687 and SEQ ID NO: 5498, respectively. In an aspect, the first gRNA molecule and the second gRNA molecule include targeting domains comprising, e.g., consisting of, SEQ ID NO: 5687 and SEQ ID NO: 5503, respectively. In an aspect, the first gRNA molecule and the second gRNA molecule include targeting domains comprising, e.g., consisting of, SEQ ID NO: 5687 and SEQ ID NO: 5496, respectively. In an aspect, the first gRNA molecule and the second gRNA molecule include targeting domains comprising, e.g., consisting of, SEQ ID NO: 5687 and SEQ ID NO: 5507, respectively. In an aspect, the first gRNA molecule and the second gRNA molecule include targeting domains comprising, e.g., consisting of, SEQ ID NO: 5687 and SEQ ID NO: 5515, respectively. In an aspect, the first gRNA molecule and the second gRNA molecule include targeting domains comprising, e.g., consisting of, SEQ ID NO: 5687 and SEQ ID NO: 5493, respectively. In an aspect, the first gRNA molecule and the second gRNA molecule include targeting domains comprising, e.g., consisting of, SEQ ID NO: 5687 and SEQ ID NO: 5506, respectively. In an aspect, the first gRNA molecule and the second gRNA molecule include targeting domains comprising, e.g., consisting of, SEQ ID NO: 5687 and SEQ ID NO: 5509, respectively. In an aspect, the first gRNA molecule and the second gRNA molecule include targeting domains comprising, e.g., consisting of, SEQ ID NO: 5687 and SEQ ID NO: 5517, respectively. In an aspect, the first gRNA molecule and the second gRNA molecule include targeting domains comprising, e.g., consisting of, SEQ ID NO: 5687 and SEQ ID NO: 5521, respectively. In an aspect, the first gRNA molecule and the second gRNA molecule include targeting domains comprising, e.g., consisting of, SEQ ID NO: 5687 and SEQ ID NO: 5520, respectively. In an aspect, the first gRNA molecule and the second gRNA molecule include targeting domains comprising, e.g., consisting of, SEQ ID NO: 5687 and SEQ ID NO: 5500, respectively. In an aspect, the first gRNA molecule and the second gRNA molecule include targeting domains comprising, e.g., consisting of, SEQ ID NO: 5687 and SEQ ID NO: 5494, respectively. In an aspect, the first gRNA molecule and the second gRNA molecule include targeting domains comprising, e.g., consisting of, SEQ ID NO: 5687 and SEQ ID NO: 5508, respectively. In an aspect, the first gRNA molecule and the second gRNA molecule include targeting domains comprising, e.g., consisting of, SEQ ID NO: 5687 and SEQ ID NO: 5514, respectively. In an aspect, the first gRNA molecule and the second gRNA molecule include targeting domains comprising, e.g., consisting of, SEQ ID NO: 5687 and SEQ ID NO: 5492, respectively. In an aspect, the first gRNA molecule and the second gRNA molecule include targeting domains comprising, e.g., consisting of, SEQ ID NO: 5705 and SEQ ID NO: 5519, respectively. In an aspect, the first gRNA molecule and the second gRNA molecule include targeting domains comprising, e.g., consisting of, SEQ ID NO: 5705 and SEQ ID NO: 5497, respectively. In an aspect, the first gRNA molecule and the second gRNA molecule include targeting domains comprising, e.g., consisting of, SEQ ID NO: 5705 and SEQ ID NO: 5499, respectively. In an aspect, the first gRNA molecule and the second gRNA molecule include targeting domains comprising, e.g., consisting of, SEQ ID NO: 5705 and SEQ ID NO: 5498, respectively. In an aspect, the first gRNA molecule and the second gRNA molecule include targeting domains comprising, e.g., consisting of, SEQ ID NO: 5705 and SEQ ID NO: 5503, respectively. In an aspect, the first gRNA molecule and the second gRNA molecule include targeting domains comprising, e.g., consisting of, SEQ ID NO: 5705 and SEQ ID NO: 5496, respectively. In an aspect, the first gRNA molecule and the second gRNA molecule include targeting domains comprising, e.g., consisting of, SEQ ID NO: 5705 and SEQ ID NO: 5507, respectively. In an aspect, the first gRNA molecule and the second gRNA molecule include targeting domains comprising, e.g., consisting of, SEQ ID NO: 5705 and SEQ ID NO: 5515, respectively. In an aspect, the first gRNA molecule and the second gRNA molecule include targeting domains comprising, e.g., consisting of, SEQ ID NO: 5705 and SEQ ID NO: 5493, respectively. In an aspect, the first gRNA molecule and the second gRNA molecule include targeting domains comprising, e.g., consisting of, SEQ ID NO: 5705 and SEQ ID NO: 5506, respectively. In an aspect, the first gRNA molecule and the second gRNA molecule include targeting domains comprising, e.g., consisting of, SEQ ID NO: 5705 and SEQ ID NO: 5509, respectively. In an aspect, the first gRNA molecule and the second gRNA molecule include targeting domains comprising, e.g., consisting of, SEQ ID NO: 5705 and SEQ ID NO: 5517, respectively. In an aspect, the first gRNA molecule and the second gRNA molecule include targeting domains comprising, e.g., consisting of, SEQ ID NO: 5705 and SEQ ID NO: 5521, respectively. In an aspect, the first gRNA molecule and the second gRNA molecule include targeting domains comprising, e.g., consisting of, SEQ ID NO: 5705 and SEQ ID NO: 5520, respectively. In an aspect, the first gRNA molecule and the second gRNA molecule include targeting domains comprising, e.g., consisting of, SEQ ID NO: 5705 and SEQ ID NO: 5500, respectively. In an aspect, the first gRNA molecule and the second gRNA molecule include targeting domains comprising, e.g., consisting of, SEQ ID NO: 5705 and SEQ ID NO: 5494, respectively. In an aspect, the first gRNA molecule and the second gRNA molecule include targeting domains comprising, e.g., consisting of, SEQ ID NO: 5705 and SEQ ID NO: 5508, respectively. In an aspect, the first gRNA molecule and the second gRNA molecule include targeting domains comprising, e.g., consisting of, SEQ ID NO: 5705 and SEQ ID NO: 5514, respectively. In an aspect, the first gRNA molecule and the second gRNA molecule include targeting domains comprising, e.g., consisting of, SEQ ID NO: 5705 and SEQ ID NO: 5492, respectively. In an aspect, the first gRNA molecule and the second gRNA molecule include targeting domains comprising, e.g., consisting of, SEQ ID NO: 5713 and SEQ ID NO: 5519, respectively. In an aspect, the first gRNA molecule and the second gRNA molecule include targeting domains comprising, e.g., consisting of, SEQ ID NO: 5713 and SEQ ID NO: 5497, respectively. In an aspect, the first gRNA molecule and the second gRNA molecule include targeting domains comprising, e.g., consisting of, SEQ ID NO: 5713 and SEQ ID NO: 5499, respectively. In an aspect, the first gRNA molecule and the second gRNA molecule include targeting domains comprising, e.g., consisting of, SEQ ID NO: 5713 and SEQ ID NO: 5498, respectively. In an aspect, the first gRNA molecule and the second gRNA molecule include targeting domains comprising, e.g., consisting of, SEQ ID NO: 5713 and SEQ ID NO: 5503, respectively. In an aspect, the first gRNA molecule and the second gRNA molecule include targeting domains comprising, e.g., consisting of, SEQ ID NO: 5713 and SEQ ID NO: 5496, respectively. In an aspect, the first gRNA molecule and the second gRNA molecule include targeting domains comprising, e.g., consisting of, SEQ ID NO: 5713 and SEQ ID NO: 5507, respectively. In an aspect, the first gRNA molecule and the second gRNA molecule include targeting domains comprising, e.g., consisting of, SEQ ID NO: 5713 and SEQ ID NO: 5515, respectively. In an aspect, the first gRNA molecule and the second gRNA molecule include targeting domains comprising, e.g., consisting of, SEQ ID NO: 5713 and SEQ ID NO: 5493, respectively. In an aspect, the first gRNA molecule and the second gRNA molecule include targeting domains comprising, e.g., consisting of, SEQ ID NO: 5713 and SEQ ID NO: 5506, respectively. In an aspect, the first gRNA molecule and the second gRNA molecule include targeting domains comprising, e.g., consisting of, SEQ ID NO: 5713 and SEQ ID NO: 5509, respectively. In an aspect, the first gRNA molecule and the second gRNA molecule include targeting domains comprising, e.g., consisting of, SEQ ID NO: 5713 and SEQ ID NO: 5517, respectively. In an aspect, the first gRNA molecule and the second gRNA molecule include targeting domains comprising, e.g., consisting of, SEQ ID NO: 5713 and SEQ ID NO: 5521, respectively. In an aspect, the first gRNA molecule and the second gRNA molecule include targeting domains comprising, e.g., consisting of, SEQ ID NO: 5713 and SEQ ID NO: 5520, respectively. In an aspect, the first gRNA molecule and the second gRNA molecule include targeting domains comprising, e.g., consisting of, SEQ ID NO: 5713 and SEQ ID NO: 5500, respectively. In an aspect, the first gRNA molecule and the second gRNA molecule include targeting domains comprising, e.g., consisting of, SEQ ID NO: 5713 and SEQ ID NO: 5494, respectively. In an aspect, the first gRNA molecule and the second gRNA molecule include targeting domains comprising, e.g., consisting of, SEQ ID NO: 5713 and SEQ ID NO: 5508, respectively. In an aspect, the first gRNA molecule and the second gRNA molecule include targeting domains comprising, e.g., consisting of, SEQ ID NO: 5713 and SEQ ID NO: 5514, respectively. In an aspect, the first gRNA molecule and the second gRNA molecule include targeting domains comprising, e.g., consisting of, SEQ ID NO: 5713 and SEQ ID NO: 5492, respectively. In an aspect, the first gRNA molecule and the second gRNA molecule include targeting domains comprising, e.g., consisting of, SEQ ID NO: 5715 and SEQ ID NO: 5519, respectively. In an aspect, the first gRNA molecule and the second gRNA molecule include targeting domains comprising, e.g., consisting of, SEQ ID NO: 5715 and SEQ ID NO: 5497, respectively. In an aspect, the first gRNA molecule and the second gRNA molecule include targeting domains comprising, e.g., consisting of, SEQ ID NO: 5715 and SEQ ID NO: 5499, respectively. In an aspect, the first gRNA molecule and the second gRNA molecule include targeting domains comprising, e.g., consisting of, SEQ ID NO: 5715 and SEQ ID NO: 5498, respectively. In an aspect, the first gRNA molecule and the second gRNA molecule include targeting domains comprising, e.g., consisting of, SEQ ID NO: 5715 and SEQ ID NO: 5503, respectively. In an aspect, the first gRNA molecule and the second gRNA molecule include targeting domains comprising, e.g., consisting of, SEQ ID NO: 5715 and SEQ ID NO: 5496, respectively. In an aspect, the first gRNA molecule and the second gRNA molecule include targeting domains comprising, e.g., consisting of, SEQ ID NO: 5715 and SEQ ID NO: 5507, respectively. In an aspect, the first gRNA molecule and the second gRNA molecule include targeting domains comprising, e.g., consisting of, SEQ ID NO: 5715 and SEQ ID NO: 5515, respectively. In an aspect, the first gRNA molecule and the second gRNA molecule include targeting domains comprising, e.g., consisting of, SEQ ID NO: 5715 and SEQ ID NO: 5493, respectively. In an aspect, the first gRNA molecule and the second gRNA molecule include targeting domains comprising, e.g., consisting of, SEQ ID NO: 5715 and SEQ ID NO: 5506, respectively. In an aspect, the first gRNA molecule and the second gRNA molecule include targeting domains comprising, e.g., consisting of, SEQ ID NO: 5715 and SEQ ID NO: 5509, respectively. In an aspect, the first gRNA molecule and the second gRNA molecule include targeting domains comprising, e.g., consisting of, SEQ ID NO: 5715 and SEQ ID NO: 5517, respectively. In an aspect, the first gRNA molecule and the second gRNA molecule include targeting domains comprising, e.g., consisting of, SEQ ID NO: 5715 and SEQ ID NO: 5521, respectively. In an aspect, the first gRNA molecule and the second gRNA molecule include targeting domains comprising, e.g., consisting of, SEQ ID NO: 5715 and SEQ ID NO: 5520, respectively. In an aspect, the first gRNA molecule and the second gRNA molecule include targeting domains comprising, e.g., consisting of, SEQ ID NO: 5715 and SEQ ID NO: 5500, respectively. In an aspect, the first gRNA molecule and the second gRNA molecule include targeting domains comprising, e.g., consisting of, SEQ ID NO: 5715 and SEQ ID NO: 5494, respectively. In an aspect, the first gRNA molecule and the second gRNA molecule include targeting domains comprising, e.g., consisting of, SEQ ID NO: 5715 and SEQ ID NO: 5508, respectively. In an aspect, the first gRNA molecule and the second gRNA molecule include targeting domains comprising, e.g., consisting of, SEQ ID NO: 5715 and SEQ ID NO: 5514, respectively. In an aspect, the first gRNA molecule and the second gRNA molecule include targeting domains comprising, e.g., consisting of, SEQ ID NO: 5715 and SEQ ID NO: 5492, respectively. In an aspect, the first gRNA molecule and the second gRNA molecule include targeting domains comprising, e.g., consisting of, SEQ ID NO: 5710 and SEQ ID NO: 5519, respectively. In an aspect, the first gRNA molecule and the second gRNA molecule include targeting domains comprising, e.g., consisting of, SEQ ID NO: 5710 and SEQ ID NO: 5497, respectively. In an aspect, the first gRNA molecule and the second gRNA molecule include targeting domains comprising, e.g., consisting of, SEQ ID NO: 5710 and SEQ ID NO: 5499, respectively. In an aspect, the first gRNA molecule and the second gRNA molecule include targeting domains comprising, e.g., consisting of, SEQ ID NO: 5710 and SEQ ID NO: 5498, respectively. In an aspect, the first gRNA molecule and the second gRNA molecule include targeting domains comprising, e.g., consisting of, SEQ ID NO: 5710 and SEQ ID NO: 5503, respectively. In an aspect, the first gRNA molecule and the second gRNA molecule include targeting domains comprising, e.g., consisting of, SEQ ID NO: 5710 and SEQ ID NO: 5496, respectively. In an aspect, the first gRNA molecule and the second gRNA molecule include targeting domains comprising, e.g., consisting of, SEQ ID NO: 5710 and SEQ ID NO: 5507, respectively. In an aspect, the first gRNA molecule and the second gRNA molecule include targeting domains comprising, e.g., consisting of, SEQ ID NO: 5710 and SEQ ID NO: 5515, respectively. In an aspect, the first gRNA molecule and the second gRNA molecule include targeting domains comprising, e.g., consisting of, SEQ ID NO: 5710 and SEQ ID NO: 5493, respectively. In an aspect, the first gRNA molecule and the second gRNA molecule include targeting domains comprising, e.g., consisting of, SEQ ID NO: 5710 and SEQ ID NO: 5506, respectively. In an aspect, the first gRNA molecule and the second gRNA molecule include targeting domains comprising, e.g., consisting of, SEQ ID NO: 5710 and SEQ ID NO: 5509, respectively. In an aspect, the first gRNA molecule and the second gRNA molecule include targeting domains comprising, e.g., consisting of, SEQ ID NO: 5710 and SEQ ID NO: 5517, respectively. In an aspect, the first gRNA molecule and the second gRNA molecule include targeting domains comprising, e.g., consisting of, SEQ ID NO: 5710 and SEQ ID NO: 5521, respectively. In an aspect, the first gRNA molecule and the second gRNA molecule include targeting domains comprising, e.g., consisting of, SEQ ID NO: 5710 and SEQ ID NO: 5520, respectively. In an aspect, the first gRNA molecule and the second gRNA molecule include targeting domains comprising, e.g., consisting of, SEQ ID NO: 5710 and SEQ ID NO: 5500, respectively. In an aspect, the first gRNA molecule and the second gRNA molecule include targeting domains comprising, e.g., consisting of, SEQ ID NO: 5710 and SEQ ID NO: 5494, respectively. In an aspect, the first gRNA molecule and the second gRNA molecule include targeting domains comprising, e.g., consisting of, SEQ ID NO: 5710 and SEQ ID NO: 5508, respectively. In an aspect, the first gRNA molecule and the second gRNA molecule include targeting domains comprising, e.g., consisting of, SEQ ID NO: 5710 and SEQ ID NO: 5514, respectively. In an aspect, the first gRNA molecule and the second gRNA molecule include targeting domains comprising, e.g., consisting of, SEQ ID NO: 5710 and SEQ ID NO: 5492, respectively. In any of the aforementioned combinations, the aspect or the embodiment of the invention may additionally include a third gRNA molecule (or more than one gRNA molecules) comprising a targeting domain specific for a sequence of CIITA, e.g. as described herein, e.g., as described herein in Table 6c.

In aspects of the invention that utilize two or more, e.g., two, gRNA molecules, it may be particularly useful for a first gRNA molecule to comprise a targeting domain specific for a sequence of TRAC and a second gRNA molecule to comprise a targeting domain specific for a sequence of PDCD1. In such aspects, it is particularly preferred that the first gRNA molecule to TRAC comprises a targeting domain of any gRNA molecule of FIG. 12, and the second gRNA molecule to PDCD1 comprises a targeting domain of any gRNA molecule of FIG. 16. In an aspect, the first gRNA molecule and the second gRNA molecule include targeting domains comprising, e.g., consisting of, SEQ ID NO: 5569 and SEQ ID NO: 5743, respectively. In an aspect, the first gRNA molecule and the second gRNA molecule include targeting domains comprising, e.g., consisting of, SEQ ID NO: 5569 and SEQ ID NO: 5497, respectively. In an aspect, the first gRNA molecule and the second gRNA molecule include targeting domains comprising, e.g., consisting of, SEQ ID NO: 5569 and SEQ ID NO: 5499, respectively. In an aspect, the first gRNA molecule and the second gRNA molecule include targeting domains comprising, e.g., consisting of, SEQ ID NO: 5569 and SEQ ID NO: 5498, respectively. In an aspect, the first gRNA molecule and the second gRNA molecule include targeting domains comprising, e.g., consisting of, SEQ ID NO: 5569 and SEQ ID NO: 5503, respectively. In an aspect, the first gRNA molecule and the second gRNA molecule include targeting domains comprising, e.g., consisting of, SEQ ID NO: 5569 and SEQ ID NO: 5496, respectively. In an aspect, the first gRNA molecule and the second gRNA molecule include targeting domains comprising, e.g., consisting of, SEQ ID NO: 5569 and SEQ ID NO: 5507, respectively. In an aspect, the first gRNA molecule and the second gRNA molecule include targeting domains comprising, e.g., consisting of, SEQ ID NO: 5569 and SEQ ID NO: 5515, respectively. In an aspect, the first gRNA molecule and the second gRNA molecule include targeting domains comprising, e.g., consisting of, SEQ ID NO: 5569 and SEQ ID NO: 5493, respectively. In an aspect, the first gRNA molecule and the second gRNA molecule include targeting domains comprising, e.g., consisting of, SEQ ID NO: 5569 and SEQ ID NO: 5506, respectively. In an aspect, the first gRNA molecule and the second gRNA molecule include targeting domains comprising, e.g., consisting of, SEQ ID NO: 5569 and SEQ ID NO: 5509, respectively. In an aspect, the first gRNA molecule and the second gRNA molecule include targeting domains comprising, e.g., consisting of, SEQ ID NO: 5569 and SEQ ID NO: 5517, respectively. In an aspect, the first gRNA molecule and the second gRNA molecule include targeting domains comprising, e.g., consisting of, SEQ ID NO: 5569 and SEQ ID NO: 5521, respectively. In an aspect, the first gRNA molecule and the second gRNA molecule include targeting domains comprising, e.g., consisting of, SEQ ID NO: 5569 and SEQ ID NO: 5520, respectively. In an aspect, the first gRNA molecule and the second gRNA molecule include targeting domains comprising, e.g., consisting of, SEQ ID NO: 5569 and SEQ ID NO: 5500, respectively. In an aspect, the first gRNA molecule and the second gRNA molecule include targeting domains comprising, e.g., consisting of, SEQ ID NO: 5585 and SEQ ID NO: 5743, respectively. In an aspect, the first gRNA molecule and the second gRNA molecule include targeting domains comprising, e.g., consisting of, SEQ ID NO: 5585 and SEQ ID NO: 5798, respectively. In an aspect, the first gRNA molecule and the second gRNA molecule include targeting domains comprising, e.g., consisting of, SEQ ID NO: 5585 and SEQ ID NO: 5748, respectively. In an aspect, the first gRNA molecule and the second gRNA molecule include targeting domains comprising, e.g., consisting of, SEQ ID NO: 5585 and SEQ ID NO: 5722, respectively. In an aspect, the first gRNA molecule and the second gRNA molecule include targeting domains comprising, e.g., consisting of, SEQ ID NO: 5585 and SEQ ID NO: 5800, respectively. In an aspect, the first gRNA molecule and the second gRNA molecule include targeting domains comprising, e.g., consisting of, SEQ ID NO: 5585 and SEQ ID NO: 5735, respectively. In an aspect, the first gRNA molecule and the second gRNA molecule include targeting domains comprising, e.g., consisting of, SEQ ID NO: 5585 and SEQ ID NO: 5724, respectively. In an aspect, the first gRNA molecule and the second gRNA molecule include targeting domains comprising, e.g., consisting of, SEQ ID NO: 5585 and SEQ ID NO: 5731, respectively. In an aspect, the first gRNA molecule and the second gRNA molecule include targeting domains comprising, e.g., consisting of, SEQ ID NO: 5585 and SEQ ID NO: 5725, respectively. In an aspect, the first gRNA molecule and the second gRNA molecule include targeting domains comprising, e.g., consisting of, SEQ ID NO: 5585 and SEQ ID NO: 5775, respectively. In an aspect, the first gRNA molecule and the second gRNA molecule include targeting domains comprising, e.g., consisting of, SEQ ID NO: 5585 and SEQ ID NO: 5766, respectively. In an aspect, the first gRNA molecule and the second gRNA molecule include targeting domains comprising, e.g., consisting of, SEQ ID NO: 5585 and SEQ ID NO: 5727, respectively. In an aspect, the first gRNA molecule and the second gRNA molecule include targeting domains comprising, e.g., consisting of, SEQ ID NO: 5585 and SEQ ID NO: 5744, respectively. In an aspect, the first gRNA molecule and the second gRNA molecule include targeting domains comprising, e.g., consisting of, SEQ ID NO: 5585 and SEQ ID NO: 5751, respectively. In an aspect, the first gRNA molecule and the second gRNA molecule include targeting domains comprising, e.g., consisting of, SEQ ID NO: 5585 and SEQ ID NO: 5734, respectively. In an aspect, the first gRNA molecule and the second gRNA molecule include targeting domains comprising, e.g., consisting of, SEQ ID NO: 5592 and SEQ ID NO: 5743, respectively. In an aspect, the first gRNA molecule and the second gRNA molecule include targeting domains comprising, e.g., consisting of, SEQ ID NO: 5592 and SEQ ID NO: 5798, respectively. In an aspect, the first gRNA molecule and the second gRNA molecule include targeting domains comprising, e.g., consisting of, SEQ ID NO: 5592 and SEQ ID NO: 5748, respectively. In an aspect, the first gRNA molecule and the second gRNA molecule include targeting domains comprising, e.g., consisting of, SEQ ID NO: 5592 and SEQ ID NO: 5722, respectively. In an aspect, the first gRNA molecule and the second gRNA molecule include targeting domains comprising, e.g., consisting of, SEQ ID NO: 5592 and SEQ ID NO: 5800, respectively. In an aspect, the first gRNA molecule and the second gRNA molecule include targeting domains comprising, e.g., consisting of, SEQ ID NO: 5592 and SEQ ID NO: 5735, respectively. In an aspect, the first gRNA molecule and the second gRNA molecule include targeting domains comprising, e.g., consisting of, SEQ ID NO: 5592 and SEQ ID NO: 5724, respectively. In an aspect, the first gRNA molecule and the second gRNA molecule include targeting domains comprising, e.g., consisting of, SEQ ID NO: 5592 and SEQ ID NO: 5731, respectively. In an aspect, the first gRNA molecule and the second gRNA molecule include targeting domains comprising, e.g., consisting of, SEQ ID NO: 5592 and SEQ ID NO: 5725, respectively. In an aspect, the first gRNA molecule and the second gRNA molecule include targeting domains comprising, e.g., consisting of, SEQ ID NO: 5592 and SEQ ID NO: 5775, respectively. In an aspect, the first gRNA molecule and the second gRNA molecule include targeting domains comprising, e.g., consisting of, SEQ ID NO: 5592 and SEQ ID NO: 5766, respectively. In an aspect, the first gRNA molecule and the second gRNA molecule include targeting domains comprising, e.g., consisting of, SEQ ID NO: 5592 and SEQ ID NO: 5727, respectively. In an aspect, the first gRNA molecule and the second gRNA molecule include targeting domains comprising, e.g., consisting of, SEQ ID NO: 5592 and SEQ ID NO: 5744, respectively. In an aspect, the first gRNA molecule and the second gRNA molecule include targeting domains comprising, e.g., consisting of, SEQ ID NO: 5592 and SEQ ID NO: 5751, respectively. In an aspect, the first gRNA molecule and the second gRNA molecule include targeting domains comprising, e.g., consisting of, SEQ ID NO: 5592 and SEQ ID NO: 5734, respectively. In an aspect, the first gRNA molecule and the second gRNA molecule include targeting domains comprising, e.g., consisting of, SEQ ID NO: 5601 and SEQ ID NO: 5743, respectively. In an aspect, the first gRNA molecule and the second gRNA molecule include targeting domains comprising, e.g., consisting of, SEQ ID NO: 5601 and SEQ ID NO: 5798, respectively. In an aspect, the first gRNA molecule and the second gRNA molecule include targeting domains comprising, e.g., consisting of, SEQ ID NO: 5601 and SEQ ID NO: 5748, respectively. In an aspect, the first gRNA molecule and the second gRNA molecule include targeting domains comprising, e.g., consisting of, SEQ ID NO: 5601 and SEQ ID NO: 5722, respectively. In an aspect, the first gRNA molecule and the second gRNA molecule include targeting domains comprising, e.g., consisting of, SEQ ID NO: 5601 and SEQ ID NO: 5800, respectively. In an aspect, the first gRNA molecule and the second gRNA molecule include targeting domains comprising, e.g., consisting of, SEQ ID NO: 5601 and SEQ ID NO: 5735, respectively. In an aspect, the first gRNA molecule and the second gRNA molecule include targeting domains comprising, e.g., consisting of, SEQ ID NO: 5601 and SEQ ID NO: 5724, respectively. In an aspect, the first gRNA molecule and the second gRNA molecule include targeting domains comprising, e.g., consisting of, SEQ ID NO: 5601 and SEQ ID NO: 5731, respectively. In an aspect, the first gRNA molecule and the second gRNA molecule include targeting domains comprising, e.g., consisting of, SEQ ID NO: 5601 and SEQ ID NO: 5725, respectively. In an aspect, the first gRNA molecule and the second gRNA molecule include targeting domains comprising, e.g., consisting of, SEQ ID NO: 5601 and SEQ ID NO: 5775, respectively. In an aspect, the first gRNA molecule and the second gRNA molecule include targeting domains comprising, e.g., consisting of, SEQ ID NO: 5601 and SEQ ID NO: 5766, respectively. In an aspect, the first gRNA molecule and the second gRNA molecule include targeting domains comprising, e.g., consisting of, SEQ ID NO: 5601 and SEQ ID NO: 5727, respectively. In an aspect, the first gRNA molecule and the second gRNA molecule include targeting domains comprising, e.g., consisting of, SEQ ID NO: 5601 and SEQ ID NO: 5744, respectively. In an aspect, the first gRNA molecule and the second gRNA molecule include targeting domains comprising, e.g., consisting of, SEQ ID NO: 5601 and SEQ ID NO: 5751, respectively. In an aspect, the first gRNA molecule and the second gRNA molecule include targeting domains comprising, e.g., consisting of, SEQ ID NO: 5601 and SEQ ID NO: 5734, respectively. In an aspect, the first gRNA molecule and the second gRNA molecule include targeting domains comprising, e.g., consisting of, SEQ ID NO: 5589 and SEQ ID NO: 5743, respectively. In an aspect, the first gRNA molecule and the second gRNA molecule include targeting domains comprising, e.g., consisting of, SEQ ID NO: 5589 and SEQ ID NO: 5798, respectively. In an aspect, the first gRNA molecule and the second gRNA molecule include targeting domains comprising, e.g., consisting of, SEQ ID NO: 5589 and SEQ ID NO: 5748, respectively. In an aspect, the first gRNA molecule and the second gRNA molecule include targeting domains comprising, e.g., consisting of, SEQ ID NO: 5589 and SEQ ID NO: 5722, respectively. In an aspect, the first gRNA molecule and the second gRNA molecule include targeting domains comprising, e.g., consisting of, SEQ ID NO: 5589 and SEQ ID NO: 5800, respectively. In an aspect, the first gRNA molecule and the second gRNA molecule include targeting domains comprising, e.g., consisting of, SEQ ID NO: 5589 and SEQ ID NO: 5735, respectively. In an aspect, the first gRNA molecule and the second gRNA molecule include targeting domains comprising, e.g., consisting of, SEQ ID NO: 5589 and SEQ ID NO: 5724, respectively. In an aspect, the first gRNA molecule and the second gRNA molecule include targeting domains comprising, e.g., consisting of, SEQ ID NO: 5589 and SEQ ID NO: 5731, respectively. In an aspect, the first gRNA molecule and the second gRNA molecule include targeting domains comprising, e.g., consisting of, SEQ ID NO: 5589 and SEQ ID NO: 5725, respectively. In an aspect, the first gRNA molecule and the second gRNA molecule include targeting domains comprising, e.g., consisting of, SEQ ID NO: 5589 and SEQ ID NO: 5775, respectively. In an aspect, the first gRNA molecule and the second gRNA molecule include targeting domains comprising, e.g., consisting of, SEQ ID NO: 5589 and SEQ ID NO: 5766, respectively. In an aspect, the first gRNA molecule and the second gRNA molecule include targeting domains comprising, e.g., consisting of, SEQ ID NO: 5589 and SEQ ID NO: 5727, respectively. In an aspect, the first gRNA molecule and the second gRNA molecule include targeting domains comprising, e.g., consisting of, SEQ ID NO: 5589 and SEQ ID NO: 5744, respectively. In an aspect, the first gRNA molecule and the second gRNA molecule include targeting domains comprising, e.g., consisting of, SEQ ID NO: 5589 and SEQ ID NO: 5751, respectively. In an aspect, the first gRNA molecule and the second gRNA molecule include targeting domains comprising, e.g., consisting of, SEQ ID NO: 5589 and SEQ ID NO: 5734, respectively. In an aspect, the first gRNA molecule and the second gRNA molecule include targeting domains comprising, e.g., consisting of, SEQ ID NO: 5600 and SEQ ID NO: 5743, respectively. In an aspect, the first gRNA molecule and the second gRNA molecule include targeting domains comprising, e.g., consisting of, SEQ ID NO: 5600 and SEQ ID NO: 5798, respectively. In an aspect, the first gRNA molecule and the second gRNA molecule include targeting domains comprising, e.g., consisting of, SEQ ID NO: 5600 and SEQ ID NO: 5748, respectively. In an aspect, the first gRNA molecule and the second gRNA molecule include targeting domains comprising, e.g., consisting of, SEQ ID NO: 5600 and SEQ ID NO: 5722, respectively. In an aspect, the first gRNA molecule and the second gRNA molecule include targeting domains comprising, e.g., consisting of, SEQ ID NO: 5600 and SEQ ID NO: 5800, respectively. In an aspect, the first gRNA molecule and the second gRNA molecule include targeting domains comprising, e.g., consisting of, SEQ ID NO: 5600 and SEQ ID NO: 5735, respectively. In an aspect, the first gRNA molecule and the second gRNA molecule include targeting domains comprising, e.g., consisting of, SEQ ID NO: 5600 and SEQ ID NO: 5724, respectively. In an aspect, the first gRNA molecule and the second gRNA molecule include targeting domains comprising, e.g., consisting of, SEQ ID NO: 5600 and SEQ ID NO: 5731, respectively. In an aspect, the first gRNA molecule and the second gRNA molecule include targeting domains comprising, e.g., consisting of, SEQ ID NO: 5600 and SEQ ID NO: 5725, respectively. In an aspect, the first gRNA molecule and the second gRNA molecule include targeting domains comprising, e.g., consisting of, SEQ ID NO: 5600 and SEQ ID NO: 5775, respectively. In an aspect, the first gRNA molecule and the second gRNA molecule include targeting domains comprising, e.g., consisting of, SEQ ID NO: 5600 and SEQ ID NO: 5766, respectively. In an aspect, the first gRNA molecule and the second gRNA molecule include targeting domains comprising, e.g., consisting of, SEQ ID NO: 5600 and SEQ ID NO: 5727, respectively. In an aspect, the first gRNA molecule and the second gRNA molecule include targeting domains comprising, e.g., consisting of, SEQ ID NO: 5600 and SEQ ID NO: 5744, respectively. In an aspect, the first gRNA molecule and the second gRNA molecule include targeting domains comprising, e.g., consisting of, SEQ ID NO: 5600 and SEQ ID NO: 5751, respectively. In an aspect, the first gRNA molecule and the second gRNA molecule include targeting domains comprising, e.g., consisting of, SEQ ID NO: 5600 and SEQ ID NO: 5734, respectively. In an aspect, the first gRNA molecule and the second gRNA molecule include targeting domains comprising, e.g., consisting of, SEQ ID NO: 5594 and SEQ ID NO: 5743, respectively. In an aspect, the first gRNA molecule and the second gRNA molecule include targeting domains comprising, e.g., consisting of, SEQ ID NO: 5594 and SEQ ID NO: 5798, respectively. In an aspect, the first gRNA molecule and the second gRNA molecule include targeting domains comprising, e.g., consisting of, SEQ ID NO: 5594 and SEQ ID NO: 5748, respectively. In an aspect, the first gRNA molecule and the second gRNA molecule include targeting domains comprising, e.g., consisting of, SEQ ID NO: 5594 and SEQ ID NO: 5722, respectively. In an aspect, the first gRNA molecule and the second gRNA molecule include targeting domains comprising, e.g., consisting of, SEQ ID NO: 5594 and SEQ ID NO: 5800, respectively. In an aspect, the first gRNA molecule and the second gRNA molecule include targeting domains comprising, e.g., consisting of, SEQ ID NO: 5594 and SEQ ID NO: 5735, respectively. In an aspect, the first gRNA molecule and the second gRNA molecule include targeting domains comprising, e.g., consisting of, SEQ ID NO: 5594 and SEQ ID NO: 5724, respectively. In an aspect, the first gRNA molecule and the second gRNA molecule include targeting domains comprising, e.g., consisting of, SEQ ID NO: 5594 and SEQ ID NO: 5731, respectively. In an aspect, the first gRNA molecule and the second gRNA molecule include targeting domains comprising, e.g., consisting of, SEQ ID NO: 5594 and SEQ ID NO: 5725, respectively. In an aspect, the first gRNA molecule and the second gRNA molecule include targeting domains comprising, e.g., consisting of, SEQ ID NO: 5594 and SEQ ID NO: 5775, respectively. In an aspect, the first gRNA molecule and the second gRNA molecule include targeting domains comprising, e.g., consisting of, SEQ ID NO: 5594 and SEQ ID NO: 5766, respectively. In an aspect, the first gRNA molecule and the second gRNA molecule include targeting domains comprising, e.g., consisting of, SEQ ID NO: 5594 and SEQ ID NO: 5727, respectively. In an aspect, the first gRNA molecule and the second gRNA molecule include targeting domains comprising, e.g., consisting of, SEQ ID NO: 5594 and SEQ ID NO: 5744, respectively. In an aspect, the first gRNA molecule and the second gRNA molecule include targeting domains comprising, e.g., consisting of, SEQ ID NO: 5594 and SEQ ID NO: 5751, respectively. In an aspect, the first gRNA molecule and the second gRNA molecule include targeting domains comprising, e.g., consisting of, SEQ ID NO: 5594 and SEQ ID NO: 5734, respectively. In an aspect, the first gRNA molecule and the second gRNA molecule include targeting domains comprising, e.g., consisting of, SEQ ID NO: 5571 and SEQ ID NO: 5743, respectively. In an aspect, the first gRNA molecule and the second gRNA molecule include targeting domains comprising, e.g., consisting of, SEQ ID NO: 5571 and SEQ ID NO: 5798, respectively. In an aspect, the first gRNA molecule and the second gRNA molecule include targeting domains comprising, e.g., consisting of, SEQ ID NO: 5571 and SEQ ID NO: 5748, respectively. In an aspect, the first gRNA molecule and the second gRNA molecule include targeting domains comprising, e.g., consisting of, SEQ ID NO: 5571 and SEQ ID NO: 5722, respectively. In an aspect, the first gRNA molecule and the second gRNA molecule include targeting domains comprising, e.g., consisting of, SEQ ID NO: 5571 and SEQ ID NO: 5800, respectively. In an aspect, the first gRNA molecule and the second gRNA molecule include targeting domains comprising, e.g., consisting of, SEQ ID NO: 5571 and SEQ ID NO: 5735, respectively. In an aspect, the first gRNA molecule and the second gRNA molecule include targeting domains comprising, e.g., consisting of, SEQ ID NO: 5571 and SEQ ID NO: 5724, respectively. In an aspect, the first gRNA molecule and the second gRNA molecule include targeting domains comprising, e.g., consisting of, SEQ ID NO: 5571 and SEQ ID NO: 5731, respectively. In an aspect, the first gRNA molecule and the second gRNA molecule include targeting domains comprising, e.g., consisting of, SEQ ID NO: 5571 and SEQ ID NO: 5725, respectively. In an aspect, the first gRNA molecule and the second gRNA molecule include targeting domains comprising, e.g., consisting of, SEQ ID NO: 5571 and SEQ ID NO: 5775, respectively. In an aspect, the first gRNA molecule and the second gRNA molecule include targeting domains comprising, e.g., consisting of, SEQ ID NO: 5571 and SEQ ID NO: 5766, respectively. In an aspect, the first gRNA molecule and the second gRNA molecule include targeting domains comprising, e.g., consisting of, SEQ ID NO: 5571 and SEQ ID NO: 5727, respectively. In an aspect, the first gRNA molecule and the second gRNA molecule include targeting domains comprising, e.g., consisting of, SEQ ID NO: 5571 and SEQ ID NO: 5744, respectively. In an aspect, the first gRNA molecule and the second gRNA molecule include targeting domains comprising, e.g., consisting of, SEQ ID NO: 5571 and SEQ ID NO: 5751, respectively. In an aspect, the first gRNA molecule and the second gRNA molecule include targeting domains comprising, e.g., consisting of, SEQ ID NO: 5571 and SEQ ID NO: 5734, respectively. In an aspect, the first gRNA molecule and the second gRNA molecule include targeting domains comprising, e.g., consisting of, SEQ ID NO: 5593 and SEQ ID NO: 5743, respectively. In an aspect, the first gRNA molecule and the second gRNA molecule include targeting domains comprising, e.g., consisting of, SEQ ID NO: 5593 and SEQ ID NO: 5798, respectively. In an aspect, the first gRNA molecule and the second gRNA molecule include targeting domains comprising, e.g., consisting of, SEQ ID NO: 5593 and SEQ ID NO: 5748, respectively. In an aspect, the first gRNA molecule and the second gRNA molecule include targeting domains comprising, e.g., consisting of, SEQ ID NO: 5593 and SEQ ID NO: 5722, respectively. In an aspect, the first gRNA molecule and the second gRNA molecule include targeting domains comprising, e.g., consisting of, SEQ ID NO: 5593 and SEQ ID NO: 5800, respectively. In an aspect, the first gRNA molecule and the second gRNA molecule include targeting domains comprising, e.g., consisting of, SEQ ID NO: 5593 and SEQ ID NO: 5735, respectively. In an aspect, the first gRNA molecule and the second gRNA molecule include targeting domains comprising, e.g., consisting of, SEQ ID NO: 5593 and SEQ ID NO: 5724, respectively. In an aspect, the first gRNA molecule and the second gRNA molecule include targeting domains comprising, e.g., consisting of, SEQ ID NO: 5593 and SEQ ID NO: 5731, respectively. In an aspect, the first gRNA molecule and the second gRNA molecule include targeting domains comprising, e.g., consisting of, SEQ ID NO: 5593 and SEQ ID NO: 5725, respectively. In an aspect, the first gRNA molecule and the second gRNA molecule include targeting domains comprising, e.g., consisting of, SEQ ID NO: 5593 and SEQ ID NO: 5775, respectively. In an aspect, the first gRNA molecule and the second gRNA molecule include targeting domains comprising, e.g., consisting of, SEQ ID NO: 5593 and SEQ ID NO: 5766, respectively. In an aspect, the first gRNA molecule and the second gRNA molecule include targeting domains comprising, e.g., consisting of, SEQ ID NO: 5593 and SEQ ID NO: 5727, respectively. In an aspect, the first gRNA molecule and the second gRNA molecule include targeting domains comprising, e.g., consisting of, SEQ ID NO: 5593 and SEQ ID NO: 5744, respectively. In an aspect, the first gRNA molecule and the second gRNA molecule include targeting domains comprising, e.g., consisting of, SEQ ID NO: 5593 and SEQ ID NO: 5751, respectively. In an aspect, the first gRNA molecule and the second gRNA molecule include targeting domains comprising, e.g., consisting of, SEQ ID NO: 5593 and SEQ ID NO: 5734, respectively. In an aspect, the first gRNA molecule and the second gRNA molecule include targeting domains comprising, e.g., consisting of, SEQ ID NO: 5574 and SEQ ID NO: 5743, respectively. In an aspect, the first gRNA molecule and the second gRNA molecule include targeting domains comprising, e.g., consisting of, SEQ ID NO: 5574 and SEQ ID NO: 5798, respectively. In an aspect, the first gRNA molecule and the second gRNA molecule include targeting domains comprising, e.g., consisting of, SEQ ID NO: 5574 and SEQ ID NO: 5748, respectively. In an aspect, the first gRNA molecule and the second gRNA molecule include targeting domains comprising, e.g., consisting of, SEQ ID NO: 5574 and SEQ ID NO: 5722, respectively. In an aspect, the first gRNA molecule and the second gRNA molecule include targeting domains comprising, e.g., consisting of, SEQ ID NO: 5574 and SEQ ID NO: 5800, respectively. In an aspect, the first gRNA molecule and the second gRNA molecule include targeting domains comprising, e.g., consisting of, SEQ ID NO: 5574 and SEQ ID NO: 5735, respectively. In an aspect, the first gRNA molecule and the second gRNA molecule include targeting domains comprising, e.g., consisting of, SEQ ID NO: 5574 and SEQ ID NO: 5724, respectively. In an aspect, the first gRNA molecule and the second gRNA molecule include targeting domains comprising, e.g., consisting of, SEQ ID NO: 5574 and SEQ ID NO: 5731, respectively. In an aspect, the first gRNA molecule and the second gRNA molecule include targeting domains comprising, e.g., consisting of, SEQ ID NO: 5574 and SEQ ID NO: 5725, respectively. In an aspect, the first gRNA molecule and the second gRNA molecule include targeting domains comprising, e.g., consisting of, SEQ ID NO: 5574 and SEQ ID NO: 5775, respectively. In an aspect, the first gRNA molecule and the second gRNA molecule include targeting domains comprising, e.g., consisting of, SEQ ID NO: 5574 and SEQ ID NO: 5766, respectively. In an aspect, the first gRNA molecule and the second gRNA molecule include targeting domains comprising, e.g., consisting of, SEQ ID NO: 5574 and SEQ ID NO: 5727, respectively. In an aspect, the first gRNA molecule and the second gRNA molecule include targeting domains comprising, e.g., consisting of, SEQ ID NO: 5574 and SEQ ID NO: 5744, respectively. In an aspect, the first gRNA molecule and the second gRNA molecule include targeting domains comprising, e.g., consisting of, SEQ ID NO: 5574 and SEQ ID NO: 5751, respectively. In an aspect, the first gRNA molecule and the second gRNA molecule include targeting domains comprising, e.g., consisting of, SEQ ID NO: 5574 and SEQ ID NO: 5734, respectively. In an aspect, the first gRNA molecule and the second gRNA molecule include targeting domains comprising, e.g., consisting of, SEQ ID NO: 5598 and SEQ ID NO: 5743, respectively. In an aspect, the first gRNA molecule and the second gRNA molecule include targeting domains comprising, e.g., consisting of, SEQ ID NO: 5598 and SEQ ID NO: 5798, respectively. In an aspect, the first gRNA molecule and the second gRNA molecule include targeting domains comprising, e.g., consisting of, SEQ ID NO: 5598 and SEQ ID NO: 5748, respectively. In an aspect, the first gRNA molecule and the second gRNA molecule include targeting domains comprising, e.g., consisting of, SEQ ID NO: 5598 and SEQ ID NO: 5722, respectively. In an aspect, the first gRNA molecule and the second gRNA molecule include targeting domains comprising, e.g., consisting of, SEQ ID NO: 5598 and SEQ ID NO: 5800, respectively. In an aspect, the first gRNA molecule and the second gRNA molecule include targeting domains comprising, e.g., consisting of, SEQ ID NO: 5598 and SEQ ID NO: 5735, respectively. In an aspect, the first gRNA molecule and the second gRNA molecule include targeting domains comprising, e.g., consisting of, SEQ ID NO: 5598 and SEQ ID NO: 5724, respectively. In an aspect, the first gRNA molecule and the second gRNA molecule include targeting domains comprising, e.g., consisting of, SEQ ID NO: 5598 and SEQ ID NO: 5731, respectively. In an aspect, the first gRNA molecule and the second gRNA molecule include targeting domains comprising, e.g., consisting of, SEQ ID NO: 5598 and SEQ ID NO: 5725, respectively. In an aspect, the first gRNA molecule and the second gRNA molecule include targeting domains comprising, e.g., consisting of, SEQ ID NO: 5598 and SEQ ID NO: 5775, respectively. In an aspect, the first gRNA molecule and the second gRNA molecule include targeting domains comprising, e.g., consisting of, SEQ ID NO: 5598 and SEQ ID NO: 5766, respectively. In an aspect, the first gRNA molecule and the second gRNA molecule include targeting domains comprising, e.g., consisting of, SEQ ID NO: 5598 and SEQ ID NO: 5727, respectively. In an aspect, the first gRNA molecule and the second gRNA molecule include targeting domains comprising, e.g., consisting of, SEQ ID NO: 5598 and SEQ ID NO: 5744, respectively. In an aspect, the first gRNA molecule and the second gRNA molecule include targeting domains comprising, e.g., consisting of, SEQ ID NO: 5598 and SEQ ID NO: 5751, respectively. In an aspect, the first gRNA molecule and the second gRNA molecule include targeting domains comprising, e.g., consisting of, SEQ ID NO: 5598 and SEQ ID NO: 5734, respectively. In an aspect, the first gRNA molecule and the second gRNA molecule include targeting domains comprising, e.g., consisting of, SEQ ID NO: 5586 and SEQ ID NO: 5743, respectively. In an aspect, the first gRNA molecule and the second gRNA molecule include targeting domains comprising, e.g., consisting of, SEQ ID NO: 5586 and SEQ ID NO: 5798, respectively. In an aspect, the first gRNA molecule and the second gRNA molecule include targeting domains comprising, e.g., consisting of, SEQ ID NO: 5586 and SEQ ID NO: 5748, respectively. In an aspect, the first gRNA molecule and the second gRNA molecule include targeting domains comprising, e.g., consisting of, SEQ ID NO: 5586 and SEQ ID NO: 5722, respectively. In an aspect, the first gRNA molecule and the second gRNA molecule include targeting domains comprising, e.g., consisting of, SEQ ID NO: 5586 and SEQ ID NO: 5800, respectively. In an aspect, the first gRNA molecule and the second gRNA molecule include targeting domains comprising, e.g., consisting of, SEQ ID NO: 5586 and SEQ ID NO: 5735, respectively. In an aspect, the first gRNA molecule and the second gRNA molecule include targeting domains comprising, e.g., consisting of, SEQ ID NO: 5586 and SEQ ID NO: 5724, respectively. In an aspect, the first gRNA molecule and the second gRNA molecule include targeting domains comprising, e.g., consisting of, SEQ ID NO: 5586 and SEQ ID NO: 5731, respectively. In an aspect, the first gRNA molecule and the second gRNA molecule include targeting domains comprising, e.g., consisting of, SEQ ID NO: 5586 and SEQ ID NO: 5725, respectively. In an aspect, the first gRNA molecule and the second gRNA molecule include targeting domains comprising, e.g., consisting of, SEQ ID NO: 5586 and SEQ ID NO: 5775, respectively. In an aspect, the first gRNA molecule and the second gRNA molecule include targeting domains comprising, e.g., consisting of, SEQ ID NO: 5586 and SEQ ID NO: 5766, respectively. In an aspect, the first gRNA molecule and the second gRNA molecule include targeting domains comprising, e.g., consisting of, SEQ ID NO: 5586 and SEQ ID NO: 5727, respectively. In an aspect, the first gRNA molecule and the second gRNA molecule include targeting domains comprising, e.g., consisting of, SEQ ID NO: 5586 and SEQ ID NO: 5744, respectively. In an aspect, the first gRNA molecule and the second gRNA molecule include targeting domains comprising, e.g., consisting of, SEQ ID NO: 5586 and SEQ ID NO: 5751, respectively. In an aspect, the first gRNA molecule and the second gRNA molecule include targeting domains comprising, e.g., consisting of, SEQ ID NO: 5586 and SEQ ID NO: 5734, respectively. In an aspect, the first gRNA molecule and the second gRNA molecule include targeting domains comprising, e.g., consisting of, SEQ ID NO: 5599 and SEQ ID NO: 5743, respectively. In an aspect, the first gRNA molecule and the second gRNA molecule include targeting domains comprising, e.g., consisting of, SEQ ID NO: 5599 and SEQ ID NO: 5798, respectively. In an aspect, the first gRNA molecule and the second gRNA molecule include targeting domains comprising, e.g., consisting of, SEQ ID NO: 5599 and SEQ ID NO: 5748, respectively. In an aspect, the first gRNA molecule and the second gRNA molecule include targeting domains comprising, e.g., consisting of, SEQ ID NO: 5599 and SEQ ID NO: 5722, respectively. In an aspect, the first gRNA molecule and the second gRNA molecule include targeting domains comprising, e.g., consisting of, SEQ ID NO: 5599 and SEQ ID NO: 5800, respectively. In an aspect, the first gRNA molecule and the second gRNA molecule include targeting domains comprising, e.g., consisting of, SEQ ID NO: 5599 and SEQ ID NO: 5735, respectively. In an aspect, the first gRNA molecule and the second gRNA molecule include targeting domains comprising, e.g., consisting of, SEQ ID NO: 5599 and SEQ ID NO: 5724, respectively. In an aspect, the first gRNA molecule and the second gRNA molecule include targeting domains comprising, e.g., consisting of, SEQ ID NO: 5599 and SEQ ID NO: 5731, respectively. In an aspect, the first gRNA molecule and the second gRNA molecule include targeting domains comprising, e.g., consisting of, SEQ ID NO: 5599 and SEQ ID NO: 5725, respectively. In an aspect, the first gRNA molecule and the second gRNA molecule include targeting domains comprising, e.g., consisting of, SEQ ID NO: 5599 and SEQ ID NO: 5775, respectively. In an aspect, the first gRNA molecule and the second gRNA molecule include targeting domains comprising, e.g., consisting of, SEQ ID NO: 5599 and SEQ ID NO: 5766, respectively. In an aspect, the first gRNA molecule and the second gRNA molecule include targeting domains comprising, e.g., consisting of, SEQ ID NO: 5599 and SEQ ID NO: 5727, respectively. In an aspect, the first gRNA molecule and the second gRNA molecule include targeting domains comprising, e.g., consisting of, SEQ ID NO: 5599 and SEQ ID NO: 5744, respectively. In an aspect, the first gRNA molecule and the second gRNA molecule include targeting domains comprising, e.g., consisting of, SEQ ID NO: 5599 and SEQ ID NO: 5751, respectively. In an aspect, the first gRNA molecule and the second gRNA molecule include targeting domains comprising, e.g., consisting of, SEQ ID NO: 5599 and SEQ ID NO: 5734, respectively. In an aspect, the first gRNA molecule and the second gRNA molecule include targeting domains comprising, e.g., consisting of, SEQ ID NO: 5591 and SEQ ID NO: 5743, respectively. In an aspect, the first gRNA molecule and the second gRNA molecule include targeting domains comprising, e.g., consisting of, SEQ ID NO: 5591 and SEQ ID NO: 5798, respectively. In an aspect, the first gRNA molecule and the second gRNA molecule include targeting domains comprising, e.g., consisting of, SEQ ID NO: 5591 and SEQ ID NO: 5748, respectively. In an aspect, the first gRNA molecule and the second gRNA molecule include targeting domains comprising, e.g., consisting of, SEQ ID NO: 5591 and SEQ ID NO: 5722, respectively. In an aspect, the first gRNA molecule and the second gRNA molecule include targeting domains comprising, e.g., consisting of, SEQ ID NO: 5591 and SEQ ID NO: 5800, respectively. In an aspect, the first gRNA molecule and the second gRNA molecule include targeting domains comprising, e.g., consisting of, SEQ ID NO: 5591 and SEQ ID NO: 5735, respectively. In an aspect, the first gRNA molecule and the second gRNA molecule include targeting domains comprising, e.g., consisting of, SEQ ID NO: 5591 and SEQ ID NO: 5724, respectively. In an aspect, the first gRNA molecule and the second gRNA molecule include targeting domains comprising, e.g., consisting of, SEQ ID NO: 5591 and SEQ ID NO: 5731, respectively. In an aspect, the first gRNA molecule and the second gRNA molecule include targeting domains comprising, e.g., consisting of, SEQ ID NO: 5591 and SEQ ID NO: 5725, respectively. In an aspect, the first gRNA molecule and the second gRNA molecule include targeting domains comprising, e.g., consisting of, SEQ ID NO: 5591 and SEQ ID NO: 5775, respectively. In an aspect, the first gRNA molecule and the second gRNA molecule include targeting domains comprising, e.g., consisting of, SEQ ID NO: 5591 and SEQ ID NO: 5766, respectively. In an aspect, the first gRNA molecule and the second gRNA molecule include targeting domains comprising, e.g., consisting of, SEQ ID NO: 5591 and SEQ ID NO: 5727, respectively. In an aspect, the first gRNA molecule and the second gRNA molecule include targeting domains comprising, e.g., consisting of, SEQ ID NO: 5591 and SEQ ID NO: 5744, respectively. In an aspect, the first gRNA molecule and the second gRNA molecule include targeting domains comprising, e.g., consisting of, SEQ ID NO: 5591 and SEQ ID NO: 5751, respectively. In an aspect, the first gRNA molecule and the second gRNA molecule include targeting domains comprising, e.g., consisting of, SEQ ID NO: 5591 and SEQ ID NO: 5734, respectively. In an aspect, the first gRNA molecule and the second gRNA molecule include targeting domains comprising, e.g., consisting of, SEQ ID NO: 5568 and SEQ ID NO: 5743, respectively. In an aspect, the first gRNA molecule and the second gRNA molecule include targeting domains comprising, e.g., consisting of, SEQ ID NO: 5568 and SEQ ID NO: 5798, respectively. In an aspect, the first gRNA molecule and the second gRNA molecule include targeting domains comprising, e.g., consisting of, SEQ ID NO: 5568 and SEQ ID NO: 5748, respectively. In an aspect, the first gRNA molecule and the second gRNA molecule include targeting domains comprising, e.g., consisting of, SEQ ID NO: 5568 and SEQ ID NO: 5722, respectively. In an aspect, the first gRNA molecule and the second gRNA molecule include targeting domains comprising, e.g., consisting of, SEQ ID NO: 5568 and SEQ ID NO: 5800, respectively. In an aspect, the first gRNA molecule and the second gRNA molecule include targeting domains comprising, e.g., consisting of, SEQ ID NO: 5568 and SEQ ID NO: 5735, respectively. In an aspect, the first gRNA molecule and the second gRNA molecule include targeting domains comprising, e.g., consisting of, SEQ ID NO: 5568 and SEQ ID NO: 5724, respectively. In an aspect, the first gRNA molecule and the second gRNA molecule include targeting domains comprising, e.g., consisting of, SEQ ID NO: 5568 and SEQ ID NO: 5731, respectively. In an aspect, the first gRNA molecule and the second gRNA molecule include targeting domains comprising, e.g., consisting of, SEQ ID NO: 5568 and SEQ ID NO: 5725, respectively. In an aspect, the first gRNA molecule and the second gRNA molecule include targeting domains comprising, e.g., consisting of, SEQ ID NO: 5568 and SEQ ID NO: 5775, respectively. In an aspect, the first gRNA molecule and the second gRNA molecule include targeting domains comprising, e.g., consisting of, SEQ ID NO: 5568 and SEQ ID NO: 5766, respectively. In an aspect, the first gRNA molecule and the second gRNA molecule include targeting domains comprising, e.g., consisting of, SEQ ID NO: 5568 and SEQ ID NO: 5727, respectively. In an aspect, the first gRNA molecule and the second gRNA molecule include targeting domains comprising, e.g., consisting of, SEQ ID NO: 5568 and SEQ ID NO: 5744, respectively. In an aspect, the first gRNA molecule and the second gRNA molecule include targeting domains comprising, e.g., consisting of, SEQ ID NO: 5568 and SEQ ID NO: 5751, respectively. In an aspect, the first gRNA molecule and the second gRNA molecule include targeting domains comprising, e.g., consisting of, SEQ ID NO: 5568 and SEQ ID NO: 5734, respectively. In an aspect, the first gRNA molecule and the second gRNA molecule include targeting domains comprising, e.g., consisting of, SEQ ID NO: 5610 and SEQ ID NO: 5743, respectively. In an aspect, the first gRNA molecule and the second gRNA molecule include targeting domains comprising, e.g., consisting of, SEQ ID NO: 5610 and SEQ ID NO: 5798, respectively. In an aspect, the first gRNA molecule and the second gRNA molecule include targeting domains comprising, e.g., consisting of, SEQ ID NO: 5610 and SEQ ID NO: 5748, respectively. In an aspect, the first gRNA molecule and the second gRNA molecule include targeting domains comprising, e.g., consisting of, SEQ ID NO: 5610 and SEQ ID NO: 5722, respectively. In an aspect, the first gRNA molecule and the second gRNA molecule include targeting domains comprising, e.g., consisting of, SEQ ID NO: 5610 and SEQ ID NO: 5800, respectively. In an aspect, the first gRNA molecule and the second gRNA molecule include targeting domains comprising, e.g., consisting of, SEQ ID NO: 5610 and SEQ ID NO: 5735, respectively. In an aspect, the first gRNA molecule and the second gRNA molecule include targeting domains comprising, e.g., consisting of, SEQ ID NO: 5610 and SEQ ID NO: 5724, respectively. In an aspect, the first gRNA molecule and the second gRNA molecule include targeting domains comprising, e.g., consisting of, SEQ ID NO: 5610 and SEQ ID NO: 5731, respectively. In an aspect, the first gRNA molecule and the second gRNA molecule include targeting domains comprising, e.g., consisting of, SEQ ID NO: 5610 and SEQ ID NO: 5725, respectively. In an aspect, the first gRNA molecule and the second gRNA molecule include targeting domains comprising, e.g., consisting of, SEQ ID NO: 5610 and SEQ ID NO: 5775, respectively. In an aspect, the first gRNA molecule and the second gRNA molecule include targeting domains comprising, e.g., consisting of, SEQ ID NO: 5610 and SEQ ID NO: 5766, respectively. In an aspect, the first gRNA molecule and the second gRNA molecule include targeting domains comprising, e.g., consisting of, SEQ ID NO: 5610 and SEQ ID NO: 5727, respectively. In an aspect, the first gRNA molecule and the second gRNA molecule include targeting domains comprising, e.g., consisting of, SEQ ID NO: 5610 and SEQ ID NO: 5744, respectively. In an aspect, the first gRNA molecule and the second gRNA molecule include targeting domains comprising, e.g., consisting of, SEQ ID NO: 5610 and SEQ ID NO: 5751, respectively. In an aspect, the first gRNA molecule and the second gRNA molecule include targeting domains comprising, e.g., consisting of, SEQ ID NO: 5610 and SEQ ID NO: 5734, respectively. In an aspect, the first gRNA molecule and the second gRNA molecule include targeting domains comprising, e.g., consisting of, SEQ ID NO: 5608 and SEQ ID NO: 5743, respectively. In an aspect, the first gRNA molecule and the second gRNA molecule include targeting domains comprising, e.g., consisting of, SEQ ID NO: 5608 and SEQ ID NO: 5798, respectively. In an aspect, the first gRNA molecule and the second gRNA molecule include targeting domains comprising, e.g., consisting of, SEQ ID NO: 5608 and SEQ ID NO: 5748, respectively. In an aspect, the first gRNA molecule and the second gRNA molecule include targeting domains comprising, e.g., consisting of, SEQ ID NO: 5608 and SEQ ID NO: 5722, respectively. In an aspect, the first gRNA molecule and the second gRNA molecule include targeting domains comprising, e.g., consisting of, SEQ ID NO: 5608 and SEQ ID NO: 5800, respectively. In an aspect, the first gRNA molecule and the second gRNA molecule include targeting domains comprising, e.g., consisting of, SEQ ID NO: 5608 and SEQ ID NO: 5735, respectively. In an aspect, the first gRNA molecule and the second gRNA molecule include targeting domains comprising, e.g., consisting of, SEQ ID NO: 5608 and SEQ ID NO: 5724, respectively. In an aspect, the first gRNA molecule and the second gRNA molecule include targeting domains comprising, e.g., consisting of, SEQ ID NO: 5608 and SEQ ID NO: 5731, respectively. In an aspect, the first gRNA molecule and the second gRNA molecule include targeting domains comprising, e.g., consisting of, SEQ ID NO: 5608 and SEQ ID NO: 5725, respectively. In an aspect, the first gRNA molecule and the second gRNA molecule include targeting domains comprising, e.g., consisting of, SEQ ID NO: 5608 and SEQ ID NO: 5775, respectively. In an aspect, the first gRNA molecule and the second gRNA molecule include targeting domains comprising, e.g., consisting of, SEQ ID NO: 5608 and SEQ ID NO: 5766, respectively. In an aspect, the first gRNA molecule and the second gRNA molecule include targeting domains comprising, e.g., consisting of, SEQ ID NO: 5608 and SEQ ID NO: 5727, respectively. In an aspect, the first gRNA molecule and the second gRNA molecule include targeting domains comprising, e.g., consisting of, SEQ ID NO: 5608 and SEQ ID NO: 5744, respectively. In an aspect, the first gRNA molecule and the second gRNA molecule include targeting domains comprising, e.g., consisting of, SEQ ID NO: 5608 and SEQ ID NO: 5751, respectively. In an aspect, the first gRNA molecule and the second gRNA molecule include targeting domains comprising, e.g., consisting of, SEQ ID NO: 5608 and SEQ ID NO: 5734, respectively. In an aspect, the first gRNA molecule and the second gRNA molecule include targeting domains comprising, e.g., consisting of, SEQ ID NO: 5617 and SEQ ID NO: 5743, respectively. In an aspect, the first gRNA molecule and the second gRNA molecule include targeting domains comprising, e.g., consisting of, SEQ ID NO: 5617 and SEQ ID NO: 5798, respectively. In an aspect, the first gRNA molecule and the second gRNA molecule include targeting domains comprising, e.g., consisting of, SEQ ID NO: 5617 and SEQ ID NO: 5748, respectively. In an aspect, the first gRNA molecule and the second gRNA molecule include targeting domains comprising, e.g., consisting of, SEQ ID NO: 5617 and SEQ ID NO: 5722, respectively. In an aspect, the first gRNA molecule and the second gRNA molecule include targeting domains comprising, e.g., consisting of, SEQ ID NO: 5617 and SEQ ID NO: 5800, respectively. In an aspect, the first gRNA molecule and the second gRNA molecule include targeting domains comprising, e.g., consisting of, SEQ ID NO: 5617 and SEQ ID NO: 5735, respectively. In an aspect, the first gRNA molecule and the second gRNA molecule include targeting domains comprising, e.g., consisting of, SEQ ID NO: 5617 and SEQ ID NO: 5724, respectively. In an aspect, the first gRNA molecule and the second gRNA molecule include targeting domains comprising, e.g., consisting of, SEQ ID NO: 5617 and SEQ ID NO: 5731, respectively. In an aspect, the first gRNA molecule and the second gRNA molecule include targeting domains comprising, e.g., consisting of, SEQ ID NO: 5617 and SEQ ID NO: 5725, respectively. In an aspect, the first gRNA molecule and the second gRNA molecule include targeting domains comprising, e.g., consisting of, SEQ ID NO: 5617 and SEQ ID NO: 5775, respectively. In an aspect, the first gRNA molecule and the second gRNA molecule include targeting domains comprising, e.g., consisting of, SEQ ID NO: 5617 and SEQ ID NO: 5766, respectively. In an aspect, the first gRNA molecule and the second gRNA molecule include targeting domains comprising, e.g., consisting of, SEQ ID NO: 5617 and SEQ ID NO: 5727, respectively. In an aspect, the first gRNA molecule and the second gRNA molecule include targeting domains comprising, e.g., consisting of, SEQ ID NO: 5617 and SEQ ID NO: 5744, respectively. In an aspect, the first gRNA molecule and the second gRNA molecule include targeting domains comprising, e.g., consisting of, SEQ ID NO: 5617 and SEQ ID NO: 5751, respectively. In an aspect, the first gRNA molecule and the second gRNA molecule include targeting domains comprising, e.g., consisting of, SEQ ID NO: 5617 and SEQ ID NO: 5734, respectively. In an aspect, the first gRNA molecule and the second gRNA molecule include targeting domains comprising, e.g., consisting of, SEQ ID NO: 5619 and SEQ ID NO: 5743, respectively. In an aspect, the first gRNA molecule and the second gRNA molecule include targeting domains comprising, e.g., consisting of, SEQ ID NO: 5619 and SEQ ID NO: 5798, respectively. In an aspect, the first gRNA molecule and the second gRNA molecule include targeting domains comprising, e.g., consisting of, SEQ ID NO: 5619 and SEQ ID NO: 5748, respectively. In an aspect, the first gRNA molecule and the second gRNA molecule include targeting domains comprising, e.g., consisting of, SEQ ID NO: 5619 and SEQ ID NO: 5722, respectively. In an aspect, the first gRNA molecule and the second gRNA molecule include targeting domains comprising, e.g., consisting of, SEQ ID NO: 5619 and SEQ ID NO: 5800, respectively. In an aspect, the first gRNA molecule and the second gRNA molecule include targeting domains comprising, e.g., consisting of, SEQ ID NO: 5619 and SEQ ID NO: 5735, respectively. In an aspect, the first gRNA molecule and the second gRNA molecule include targeting domains comprising, e.g., consisting of, SEQ ID NO: 5619 and SEQ ID NO: 5724, respectively. In an aspect, the first gRNA molecule and the second gRNA molecule include targeting domains comprising, e.g., consisting of, SEQ ID NO: 5619 and SEQ ID NO: 5731, respectively. In an aspect, the first gRNA molecule and the second gRNA molecule include targeting domains comprising, e.g., consisting of, SEQ ID NO: 5619 and SEQ ID NO: 5725, respectively. In an aspect, the first gRNA molecule and the second gRNA molecule include targeting domains comprising, e.g., consisting of, SEQ ID NO: 5619 and SEQ ID NO: 5775, respectively. In an aspect, the first gRNA molecule and the second gRNA molecule include targeting domains comprising, e.g., consisting of, SEQ ID NO: 5619 and SEQ ID NO: 5766, respectively. In an aspect, the first gRNA molecule and the second gRNA molecule include targeting domains comprising, e.g., consisting of, SEQ ID NO: 5619 and SEQ ID NO: 5727, respectively. In an aspect, the first gRNA molecule and the second gRNA molecule include targeting domains comprising, e.g., consisting of, SEQ ID NO: 5619 and SEQ ID NO: 5744, respectively. In an aspect, the first gRNA molecule and the second gRNA molecule include targeting domains comprising, e.g., consisting of, SEQ ID NO: 5619 and SEQ ID NO: 5751, respectively. In an aspect, the first gRNA molecule and the second gRNA molecule include targeting domains comprising, e.g., consisting of, SEQ ID NO: 5619 and SEQ ID NO: 5734, respectively. In an aspect, the first gRNA molecule and the second gRNA molecule include targeting domains comprising, e.g., consisting of, SEQ ID NO: 5620 and SEQ ID NO: 5743, respectively. In an aspect, the first gRNA molecule and the second gRNA molecule include targeting domains comprising, e.g., consisting of, SEQ ID NO: 5620 and SEQ ID NO: 5798, respectively. In an aspect, the first gRNA molecule and the second gRNA molecule include targeting domains comprising, e.g., consisting of, SEQ ID NO: 5620 and SEQ ID NO: 5748, respectively. In an aspect, the first gRNA molecule and the second gRNA molecule include targeting domains comprising, e.g., consisting of, SEQ ID NO: 5620 and SEQ ID NO: 5722, respectively. In an aspect, the first gRNA molecule and the second gRNA molecule include targeting domains comprising, e.g., consisting of, SEQ ID NO: 5620 and SEQ ID NO: 5800, respectively. In an aspect, the first gRNA molecule and the second gRNA molecule include targeting domains comprising, e.g., consisting of, SEQ ID NO: 5620 and SEQ ID NO: 5735, respectively. In an aspect, the first gRNA molecule and the second gRNA molecule include targeting domains comprising, e.g., consisting of, SEQ ID NO: 5620 and SEQ ID NO: 5724, respectively. In an aspect, the first gRNA molecule and the second gRNA molecule include targeting domains comprising, e.g., consisting of, SEQ ID NO: 5620 and SEQ ID NO: 5731, respectively. In an aspect, the first gRNA molecule and the second gRNA molecule include targeting domains comprising, e.g., consisting of, SEQ ID NO: 5620 and SEQ ID NO: 5725, respectively. In an aspect, the first gRNA molecule and the second gRNA molecule include targeting domains comprising, e.g., consisting of, SEQ ID NO: 5620 and SEQ ID NO: 5775, respectively. In an aspect, the first gRNA molecule and the second gRNA molecule include targeting domains comprising, e.g., consisting of, SEQ ID NO: 5620 and SEQ ID NO: 5766, respectively. In an aspect, the first gRNA molecule and the second gRNA molecule include targeting domains comprising, e.g., consisting of, SEQ ID NO: 5620 and SEQ ID NO: 5727, respectively. In an aspect, the first gRNA molecule and the second gRNA molecule include targeting domains comprising, e.g., consisting of, SEQ ID NO: 5620 and SEQ ID NO: 5744, respectively. In an aspect, the first gRNA molecule and the second gRNA molecule include targeting domains comprising, e.g., consisting of, SEQ ID NO: 5620 and SEQ ID NO: 5751, respectively. In an aspect, the first gRNA molecule and the second gRNA molecule include targeting domains comprising, e.g., consisting of, SEQ ID NO: 5620 and SEQ ID NO: 5734, respectively.

As described herein, it is contemplated to generate a cell (or population of cells), e.g., an immune effector cell, e.g., a CAR-expressing immune effector cell, e.g., as described herein, which has reduced or eliminated expression of TRAC, B2M and CIITA. While it is contemplated that gRNAs comprising any targeting domain disclosed herein to each of these targets may be used in combination, particularly preferred targeting domain sequences to be used, for example, in combination are provided in the Table 33 below. In embodiments, each of the gRNA molecules are provided in dual guide RNA format and include a crRNA comprising, e.g., consisting of, the sequence [targeting domain]-SEQ ID NO: 6607, and a tracr comprising, e.g., consisting of, the sequence of SEQ ID NO: 6660. In other embodiments, each of the gRNA molecules are provided in single guide RNA format comprising, e.g., consisting of, the sequence: [targeting domain]-SEQ ID NO: 6601. In other embodiments, each of the gRNA molecules are provided in single guide RNA format comprising, e.g., consisting of, the sequence: [targeting domain]-SEQ ID NO: 7811. In embodiments, one or more of the gRNA molecules, e.g., all of the gRNA molecules, additionally comprise one or more modifications described herein, e.g., comprise one or more, e.g., 3, 3' and/or 5' phosphorothioate bonds, and/or one or more, e.g., 3, 3' and/or 5' 2'-OMe modifications. In embodiments, each of the gRNA molecules is complexed with a Cas9 molecule (e.g., described herein) and delivered to the cell (or population of cells, e.g., as described herein) as RNP, e.g., by electroporation. In embodiments, the RNP comprising each gRNA molecule are mixed with the cells and introduced simultaneously, e.g., by a single electroporation step. In other embodiments, the RNP may be introduced sequentially. Where it is contemplated to reduce or eliminate expression of both B2M and CIITA in a cell (such as here), in embodiments the cells may be further engineered to express a NK inhibitory molecule, e.g., as described herein, e.g., an HLA-G:B2M fusion described herein.

TABLE 33

Examples of preferred targeting domains of first, second and third gRNA molecules that can be used in combination to reduce or eliminate expression of TRAC, B2M and CIITA in a cell (as described herein).

| Combination Number | SEQ ID NO: s of targeting domains of first gRNA, second gRNA and third gRNA, respectively |
|---|---|
| A1 | SEQ ID NO: 5569 and SEQ ID NO: 7769 and SEQ ID NO: 5496 |
| A2 | SEQ ID NO: 5569 and SEQ ID NO: 7771 and SEQ ID NO: 5496 |
| A3 | SEQ ID NO: 5569 and SEQ ID NO: 7739 and SEQ ID NO: 5496 |
| A4 | SEQ ID NO: 5569 and SEQ ID NO: 7785 and SEQ ID NO: 5496 |
| A5 | SEQ ID NO: 5569 and SEQ ID NO: 7769 and SEQ ID NO: 5498 |
| A6 | SEQ ID NO: 5569 and SEQ ID NO: 7771 and SEQ ID NO: 5498 |
| A7 | SEQ ID NO: 5569 and SEQ ID NO: 7739 and SEQ ID NO: 5498 |
| A8 | SEQ ID NO: 5569 and SEQ ID NO: 7785 and SEQ ID NO: 5498 |

TABLE 33-continued

Examples of preferred targeting domains of first, second and third gRNA molecules that can be used in combination to reduce or eliminate expression of TRAC, B2M and CIITA in a cell (as described herein).

| Combination Number | SEQ ID NO: s of targeting domains of first gRNA, second gRNA and third gRNA, respectively |
|---|---|
| A9 | SEQ ID NO: 5569 and SEQ ID NO: 7769 and SEQ ID NO: 5509 |
| A10 | SEQ ID NO: 5569 and SEQ ID NO: 7771 and SEQ ID NO: 5509 |
| A11 | SEQ ID NO: 5569 and SEQ ID NO: 7739 and SEQ ID NO: 5509 |
| A12 | SEQ ID NO: 5569 and SEQ ID NO: 7785 and SEQ ID NO: 5509 |
| A13 | SEQ ID NO: 5586 and SEQ ID NO: 7769 and SEQ ID NO: 5496 |
| A14 | SEQ ID NO: 5586 and SEQ ID NO: 7771 and SEQ ID NO: 5496 |
| A15 | SEQ ID NO: 5586 and SEQ ID NO: 7739 and SEQ ID NO: 5496 |
| A16 | SEQ ID NO: 5586 and SEQ ID NO: 7785 and SEQ ID NO: 5496 |
| A17 | SEQ ID NO: 5586 and SEQ ID NO: 7769 and SEQ ID NO: 5498 |
| A18 | SEQ ID NO: 5586 and SEQ ID NO: 7771 and SEQ ID NO: 5498 |
| A19 | SEQ ID NO: 5586 and SEQ ID NO: 7739 and SEQ ID NO: 5498 |
| A20 | SEQ ID NO: 5586 and SEQ ID NO: 7785 and SEQ ID NO: 5498 |
| A21 | SEQ ID NO: 5586 and SEQ ID NO: 7769 and SEQ ID NO: 5509 |
| A22 | SEQ ID NO: 5586 and SEQ ID NO: 7771 and SEQ ID NO: 5509 |
| A23 | SEQ ID NO: 5586 and SEQ ID NO: 7739 and SEQ ID NO: 5509 |
| A24 | SEQ ID NO: 5586 and SEQ ID NO: 7785 and SEQ ID NO: 5509 |
| A25 | SEQ ID NO: 5587 and SEQ ID NO: 7769 and SEQ ID NO: 5496 |
| A26 | SEQ ID NO: 5587 and SEQ ID NO: 7771 and SEQ ID NO: 5496 |
| A27 | SEQ ID NO: 5587 and SEQ ID NO: 7739 and SEQ ID NO: 5496 |
| A28 | SEQ ID NO: 5587 and SEQ ID NO: 7785 and SEQ ID NO: 5496 |
| A29 | SEQ ID NO: 5587 and SEQ ID NO: 7769 and SEQ ID NO: 5498 |
| A30 | SEQ ID NO: 5587 and SEQ ID NO: 7771 and SEQ ID NO: 5498 |
| A31 | SEQ ID NO: 5587 and SEQ ID NO: 7739 and SEQ ID NO: 5498 |
| A32 | SEQ ID NO: 5587 and SEQ ID NO: 7785 and SEQ ID NO: 5498 |
| A33 | SEQ ID NO: 5587 and SEQ ID NO: 7769 and SEQ ID NO: 5509 |
| A34 | SEQ ID NO: 5587 and SEQ ID NO: 7771 and SEQ ID NO: 5509 |
| A35 | SEQ ID NO: 5587 and SEQ ID NO: 7739 and SEQ ID NO: 5509 |
| A36 | SEQ ID NO: 5587 and SEQ ID NO: 7785 and SEQ ID NO: 5509 |
| A37 | SEQ ID NO: 5592 and SEQ ID NO: 7769 and SEQ ID NO: 5496 |
| A38 | SEQ ID NO: 5592 and SEQ ID NO: 7771 and SEQ ID NO: 5496 |
| A39 | SEQ ID NO: 5592 and SEQ ID NO: 7739 and SEQ ID NO: 5496 |
| A40 | SEQ ID NO: 5592 and SEQ ID NO: 7785 and SEQ ID NO: 5496 |
| A41 | SEQ ID NO: 5592 and SEQ ID NO: 7769 and SEQ ID NO: 5498 |
| A42 | SEQ ID NO: 5592 and SEQ ID NO: 7771 and SEQ ID NO: 5498 |
| A43 | SEQ ID NO: 5592 and SEQ ID NO: 7739 and SEQ ID NO: 5498 |

TABLE 33-continued

Examples of preferred targeting domains of first, second and third gRNA molecules that can be used in combination to reduce or eliminate expression of TRAC, B2M and CIITA in a cell (as described herein).

| Combination Number | SEQ ID NO: s of targeting domains of first gRNA, second gRNA and third gRNA, respectively |
|---|---|
| A44 | SEQ ID NO: 5592 and SEQ ID NO: 7785 and SEQ ID NO: 5498 |
| A45 | SEQ ID NO: 5592 and SEQ ID NO: 7769 and SEQ ID NO: 5509 |
| A46 | SEQ ID NO: 5592 and SEQ ID NO: 7771 and SEQ ID NO: 5509 |
| A47 | SEQ ID NO: 5592 and SEQ ID NO: 7739 and SEQ ID NO: 5509 |
| A48 | SEQ ID NO: 5592 and SEQ ID NO: 7785 and SEQ ID NO: 5509 |
| A49 | SEQ ID NO: 5599 and SEQ ID NO: 7769 and SEQ ID NO: 5496 |
| A50 | SEQ ID NO: 5599 and SEQ ID NO: 7771 and SEQ ID NO: 5496 |
| A51 | SEQ ID NO: 5599 and SEQ ID NO: 7739 and SEQ ID NO: 5496 |
| A52 | SEQ ID NO: 5599 and SEQ ID NO: 7785 and SEQ ID NO: 5496 |
| A53 | SEQ ID NO: 5599 and SEQ ID NO: 7769 and SEQ ID NO: 5498 |
| A54 | SEQ ID NO: 5599 and SEQ ID NO: 7771 and SEQ ID NO: 5498 |
| A55 | SEQ ID NO: 5599 and SEQ ID NO: 7739 and SEQ ID NO: 5498 |
| A56 | SEQ ID NO: 5599 and SEQ ID NO: 7785 and SEQ ID NO: 5498 |
| A57 | SEQ ID NO: 5599 and SEQ ID NO: 7769 and SEQ ID NO: 5509 |
| A58 | SEQ ID NO: 5599 and SEQ ID NO: 7771 and SEQ ID NO: 5509 |
| A59 | SEQ ID NO: 5599 and SEQ ID NO: 7739 and SEQ ID NO: 5509 |
| A60 | SEQ ID NO: 5599 and SEQ ID NO: 7785 and SEQ ID NO: 5509 |
| A61 | SEQ ID NO: 5600 and SEQ ID NO: 7769 and SEQ ID NO: 5496 |
| A62 | SEQ ID NO: 5600 and SEQ ID NO: 7771 and SEQ ID NO: 5496 |
| A63 | SEQ ID NO: 5600 and SEQ ID NO: 7739 and SEQ ID NO: 5496 |
| A64 | SEQ ID NO: 5600 and SEQ ID NO: 7785 and SEQ ID NO: 5496 |
| A65 | SEQ ID NO: 5600 and SEQ ID NO: 7769 and SEQ ID NO: 5498 |
| A66 | SEQ ID NO: 5600 and SEQ ID NO: 7771 and SEQ ID NO: 5498 |
| A67 | SEQ ID NO: 5600 and SEQ ID NO: 7739 and SEQ ID NO: 5498 |
| A68 | SEQ ID NO: 5600 and SEQ ID NO: 7785 and SEQ ID NO: 5498 |
| A69 | SEQ ID NO: 5600 and SEQ ID NO: 7769 and SEQ ID NO: 5509 |
| A70 | SEQ ID NO: 5600 and SEQ ID NO: 7771 and SEQ ID NO: 5509 |
| A71 | SEQ ID NO: 5600 and SEQ ID NO: 7739 and SEQ ID NO: 5509 |
| A72 | SEQ ID NO: 5600 and SEQ ID NO: 7785 and SEQ ID NO: 5509 |

Particularly preferred combinations include combination A1 to A4, combination A5 to A8, combination A37 to A40, or combination A41 to A44.

As described herein, it is contemplated to generate a cell (or population of cells), e.g., an immune effector cell, e.g., a CAR-expressing immune effector cell, e.g., as described herein, which has reduced or eliminated expression of CD3E, B2M and CIITA. While it is contemplated that gRNAs comprising any targeting domain disclosed herein to each of these targets may be used in combination, particularly preferred targeting domain sequences to be used, for example, in combination are provided in the Table 34 below. In embodiments, each of the gRNA molecules are provided in dual guide RNA format and include a crRNA comprising, e.g., consisting of, the sequence [targeting domain]-SEQ ID NO: 6607, and a tracr comprising, e.g., consisting of, the sequence of SEQ ID NO: 6660. In other embodiments, each of the gRNA molecules are provided in single guide RNA format comprising, e.g., consisting of, the sequence: [targeting domain]-SEQ ID NO: 6601. In other embodiments, each of the gRNA molecules are provided in single guide RNA format comprising, e.g., consisting of, the sequence: [targeting domain]-SEQ ID NO: 7811. In embodiments, one or more of the gRNA molecules, e.g., all of the gRNA molecules, additionally comprise one or more modifications described herein, e.g., comprise one or more, e.g., 3, 3' and/or 5' phosphorothioate bonds, and/or one or more, e.g., 3, 3' and/or 5' 2'-OMe modifications. In embodiments, each of the gRNA molecules is complexed with a Cas9 molecule (e.g., described herein) and delivered to the cell (or population of cells, e.g., as described herein) as RNP, e.g., by electroporation. In embodiments, the RNP comprising each gRNA molecule are mixed with the cells and introduced simultaneously, e.g., by a single electroporation step. In other embodiments, the RNP may be introduced sequentially. Where it is contemplated to reduce or eliminate expression of both B2M and CIITA in a cell (such as here), in embodiments the cells may be further engineered to express a NK inhibitory molecule, e.g., as described herein, e.g., an HLA-G:B2M fusion described herein.

TABLE 34

Examples of preferred targeting domains of first, second and third gRNA molecules that can be used in combination to reduce or eliminate expression of CD3E, B2M and CIITA in a cell (as described herein).

| Combination Number | SEQ ID NO: s of targeting domains of first gRNA, second gRNA and third gRNA, respectively |
|---|---|
| B1 | SEQ ID NO: 10729 and SEQ ID NO: 7769 and SEQ ID NO: 5496 |
| B2 | SEQ ID NO: 10729 and SEQ ID NO: 7771 and SEQ ID NO: 5496 |
| B3 | SEQ ID NO: 10729 and SEQ ID NO: 7739 and SEQ ID NO: 5496 |
| B4 | SEQ ID NO: 10729 and SEQ ID NO: 7785 and SEQ ID NO: 5496 |
| B5 | SEQ ID NO: 10729 and SEQ ID NO: 7769 and SEQ ID NO: 5498 |
| B6 | SEQ ID NO: 10729 and SEQ ID NO: 7771 and SEQ ID NO: 5498 |
| B7 | SEQ ID NO: 10729 and SEQ ID NO: 7739 and SEQ ID NO: 5498 |
| B8 | SEQ ID NO: 10729 and SEQ ID NO: 7785 and SEQ ID NO: 5498 |
| B9 | SEQ ID NO: 10729 and SEQ ID NO: 7769 and SEQ ID NO: 5509 |
| B10 | SEQ ID NO: 10729 and SEQ ID NO: 7771 and SEQ ID NO: 5509 |
| B11 | SEQ ID NO: 10729 and SEQ ID NO: 7739 and SEQ ID NO: 5509 |
| B12 | SEQ ID NO: 10729 and SEQ ID NO: 7785 and SEQ ID NO: 5509 |
| B13 | SEQ ID NO: 10719 and SEQ ID NO: 7769 and SEQ ID NO: 5496 |
| B14 | SEQ ID NO: 10719 and SEQ ID NO: 7771 and SEQ ID NO: 5496 |
| B15 | SEQ ID NO: 10719 and SEQ ID NO: 7739 and SEQ ID NO: 5496 |

TABLE 34-continued

Examples of preferred targeting domains of first, second and third gRNA molecules that can be used in combination to reduce or eliminate expression of CD3E, B2M and CIITA in a cell (as described herein).

| Combination Number | SEQ ID NO: s of targeting domains of first gRNA, second gRNA and third gRNA, respectively |
|---|---|
| B16 | SEQ ID NO: 10719 and SEQ ID NO: 7785 and SEQ ID NO: 5496 |
| B17 | SEQ ID NO: 10719 and SEQ ID NO: 7769 and SEQ ID NO: 5498 |
| B18 | SEQ ID NO: 10719 and SEQ ID NO: 7771 and SEQ ID NO: 5498 |
| B19 | SEQ ID NO: 10719 and SEQ ID NO: 7739 and SEQ ID NO: 5498 |
| B20 | SEQ ID NO: 10719 and SEQ ID NO: 7785 and SEQ ID NO: 5498 |
| B21 | SEQ ID NO: 10719 and SEQ ID NO: 7769 and SEQ ID NO: 5509 |
| B22 | SEQ ID NO: 10719 and SEQ ID NO: 7771 and SEQ ID NO: 5509 |
| B23 | SEQ ID NO: 10719 and SEQ ID NO: 7739 and SEQ ID NO: 5509 |
| B24 | SEQ ID NO: 10719 and SEQ ID NO: 7785 and SEQ ID NO: 5509 |
| B25 | SEQ ID NO: 10764 and SEQ ID NO: 7769 and SEQ ID NO: 5496 |
| B26 | SEQ ID NO: 10764 and SEQ ID NO: 7771 and SEQ ID NO: 5496 |
| B27 | SEQ ID NO: 10764 and SEQ ID NO: 7739 and SEQ ID NO: 5496 |
| B28 | SEQ ID NO: 10764 and SEQ ID NO: 7785 and SEQ ID NO: 5496 |
| B29 | SEQ ID NO: 10764 and SEQ ID NO: 7769 and SEQ ID NO: 5498 |
| B30 | SEQ ID NO: 10764 and SEQ ID NO: 7771 and SEQ ID NO: 5498 |
| B31 | SEQ ID NO: 10764 and SEQ ID NO: 7739 and SEQ ID NO: 5498 |
| B32 | SEQ ID NO: 10764 and SEQ ID NO: 7785 and SEQ ID NO: 5498 |
| B33 | SEQ ID NO: 10764 and SEQ ID NO: 7769 and SEQ ID NO: 5509 |
| B34 | SEQ ID NO: 10764 and SEQ ID NO: 7771 and SEQ ID NO: 5509 |
| B35 | SEQ ID NO: 10764 and SEQ ID NO: 7739 and SEQ ID NO: 5509 |
| B36 | SEQ ID NO: 10764 and SEQ ID NO: 7785 and SEQ ID NO: 5509 |
| B37 | SEQ ID NO: 10689 and SEQ ID NO: 7769 and SEQ ID NO: 5496 |
| B38 | SEQ ID NO: 10689 and SEQ ID NO: 7771 and SEQ ID NO: 5496 |
| B39 | SEQ ID NO: 10689 and SEQ ID NO: 7739 and SEQ ID NO: 5496 |
| B40 | SEQ ID NO: 10689 and SEQ ID NO: 7785 and SEQ ID NO: 5496 |
| B41 | SEQ ID NO: 10689 and SEQ ID NO: 7769 and SEQ ID NO: 5498 |
| B42 | SEQ ID NO: 10689 and SEQ ID NO: 7771 and SEQ ID NO: 5498 |
| B43 | SEQ ID NO: 10689 and SEQ ID NO: 7739 and SEQ ID NO: 5498 |
| B44 | SEQ ID NO: 10689 and SEQ ID NO: 7785 and SEQ ID NO: 5498 |
| B45 | SEQ ID NO: 10689 and SEQ ID NO: 7769 and SEQ ID NO: 5509 |
| B46 | SEQ ID NO: 10689 and SEQ ID NO: 7771 and SEQ ID NO: 5509 |
| B47 | SEQ ID NO: 10689 and SEQ ID NO: 7739 and SEQ ID NO: 5509 |
| B48 | SEQ ID NO: 10689 and SEQ ID NO: 7785 and SEQ ID NO: 5509 |
| B49 | SEQ ID NO: 10701 and SEQ ID NO: 7769 and SEQ ID NO: 5496 |
| B50 | SEQ ID NO: 10701 and SEQ ID NO: 7771 and SEQ ID NO: 5496 |
| B51 | SEQ ID NO: 10701 and SEQ ID NO: 7739 and SEQ ID NO: 5496 |
| B52 | SEQ ID NO: 10701 and SEQ ID NO: 7785 and SEQ ID NO: 5496 |
| B53 | SEQ ID NO: 10701 and SEQ ID NO: 7769 and SEQ ID NO: 5498 |
| B54 | SEQ ID NO: 10701 and SEQ ID NO: 7771 and SEQ ID NO: 5498 |
| B55 | SEQ ID NO: 10701 and SEQ ID NO: 7739 and SEQ ID NO: 5498 |
| B56 | SEQ ID NO: 10701 and SEQ ID NO: 7785 and SEQ ID NO: 5498 |
| B57 | SEQ ID NO: 10701 and SEQ ID NO: 7769 and SEQ ID NO: 5509 |
| B58 | SEQ ID NO: 10701 and SEQ ID NO: 7771 and SEQ ID NO: 5509 |
| B59 | SEQ ID NO: 10701 and SEQ ID NO: 7739 and SEQ ID NO: 5509 |
| B60 | SEQ ID NO: 10701 and SEQ ID NO: 7785 and SEQ ID NO: 5509 |
| B61 | SEQ ID NO: 10700 and SEQ ID NO: 7769 and SEQ ID NO: 5496 |
| B62 | SEQ ID NO: 10700 and SEQ ID NO: 7771 and SEQ ID NO: 5496 |
| B63 | SEQ ID NO: 10700 and SEQ ID NO: 7739 and SEQ ID NO: 5496 |
| B64 | SEQ ID NO: 10700 and SEQ ID NO: 7785 and SEQ ID NO: 5496 |
| B65 | SEQ ID NO: 10700 and SEQ ID NO: 7769 and SEQ ID NO: 5498 |
| B66 | SEQ ID NO: 10700 and SEQ ID NO: 7771 and SEQ ID NO: 5498 |
| B67 | SEQ ID NO: 10700 and SEQ ID NO: 7739 and SEQ ID NO: 5498 |
| B68 | SEQ ID NO: 10700 and SEQ ID NO: 7785 and SEQ ID NO: 5498 |
| B69 | SEQ ID NO: 10700 and SEQ ID NO: 7769 and SEQ ID NO: 5509 |
| B70 | SEQ ID NO: 10700 and SEQ ID NO: 7771 and SEQ ID NO: 5509 |
| B71 | SEQ ID NO: 10700 and SEQ ID NO: 7739 and SEQ ID NO: 5509 |
| B72 | SEQ ID NO: 10700 and SEQ ID NO: 7785 and SEQ ID NO: 5509 |
| B73 | SEQ ID NO: 10722 and SEQ ID NO: 7769 and SEQ ID NO: 5496 |
| B74 | SEQ ID NO: 10722 and SEQ ID NO: 7771 and SEQ ID NO: 5496 |
| B75 | SEQ ID NO: 10722 and SEQ ID NO: 7739 and SEQ ID NO: 5496 |
| B76 | SEQ ID NO: 10722 and SEQ ID NO: 7785 and SEQ ID NO: 5496 |
| B77 | SEQ ID NO: 10722 and SEQ ID NO: 7769 and SEQ ID NO: 5498 |
| B78 | SEQ ID NO: 10722 and SEQ ID NO: 7771 and SEQ ID NO: 5498 |
| B79 | SEQ ID NO: 10722 and SEQ ID NO: 7739 and SEQ ID NO: 5498 |
| B80 | SEQ ID NO: 10722 and SEQ ID NO: 7785 and SEQ ID NO: 5498 |
| B81 | SEQ ID NO: 10722 and SEQ ID NO: 7769 and SEQ ID NO: 5509 |
| B82 | SEQ ID NO: 10722 and SEQ ID NO: 7771 and SEQ ID NO: 5509 |
| B83 | SEQ ID NO: 10722 and SEQ ID NO: 7739 and SEQ ID NO: 5509 |
| B84 | SEQ ID NO: 10722 and SEQ ID NO: 7785 and SEQ ID NO: 5509 |

As described herein, it is contemplated to generate a cell (or population of cells), e.g., an immune effector cell, e.g., a CAR-expressing immune effector cell, e.g., as described herein, which has reduced or eliminated expression of TRBC, B2M and CIITA. While it is contemplated that gRNAs comprising any targeting domain disclosed herein to each of these targets may be used in combination, particularly preferred targeting domain sequences to be used, for example, in combination are provided in the Table 38 below. In embodiments, each of the gRNA molecules are provided in dual guide RNA format and include a crRNA comprising, e.g., consisting of, the sequence [targeting domain]-SEQ ID NO: 6607, and a tracr comprising, e.g., consisting of, the sequence of SEQ ID NO: 6660. In other embodiments, each of the gRNA molecules are provided in single guide RNA format comprising, e.g., consisting of, the sequence: [targeting domain]-SEQ ID NO: 6601. In other embodiments, each of the gRNA molecules are provided in single guide RNA format comprising, e.g., consisting of, the sequence: [targeting domain]-SEQ ID NO: 7811. In embodiments, one or more of the gRNA molecules, e.g., all of the gRNA molecules, additionally comprise one or more modifications described herein, e.g., comprise one or more, e.g., 3, 3' and/or 5' phosphorothioate bonds, and/or one or more, e.g., 3, 3' and/or 5' 2'-OMe modifications. In embodiments, each of the gRNA molecules is complexed with a Cas9 molecule (e.g., described herein) and delivered to the cell (or population of cells, e.g., as described herein) as RNP, e.g., by electroporation. In embodiments, the RNP comprising each gRNA molecule are mixed with the cells and introduced simultaneously, e.g., by a single electroporation step. In other embodiments, the RNP may be introduced sequentially. Where it is contemplated to reduce or eliminate expression of both B2M and CIITA in a cell (such as here), in embodiments the cells may be further engineered to express a NK inhibitory molecule, e.g., as described herein, e.g., an HLA-G:B2M fusion described herein.

TABLE 38

Examples of preferred targeting domains of first, second and third gRNA molecules that can be used in combination to reduce or eliminate expression of TRBC, B2M and CIITA in a cell (as described herein).

| Combination Number | SEQ ID NO: s of targeting domains of first gRNA, second gRNA and third gRNA, respectively |
|---|---|
| F1 | SEQ ID NO: 5719 and SEQ ID NO: 5496 and SEQ ID NO: 7769 |
| F2 | SEQ ID NO: 5719 and SEQ ID NO: 5496 and SEQ ID NO: 7771 |
| F3 | SEQ ID NO: 5719 and SEQ ID NO: 5496 and SEQ ID NO: 7739 |
| F4 | SEQ ID NO: 5719 and SEQ ID NO: 5496 and SEQ ID NO: 7785 |
| F5 | SEQ ID NO: 5719 and SEQ ID NO: 5498 and SEQ ID NO: 7769 |
| F6 | SEQ ID NO: 5719 and SEQ ID NO: 5498 and SEQ ID NO: 7771 |
| F7 | SEQ ID NO: 5719 and SEQ ID NO: 5498 and SEQ ID NO: 7739 |
| F8 | SEQ ID NO: 5719 and SEQ ID NO: 5498 and SEQ ID NO: 7785 |
| F9 | SEQ ID NO: 5719 and SEQ ID NO: 5499 and SEQ ID NO: 7769 |
| F10 | SEQ ID NO: 5719 and SEQ ID NO: 5499 and SEQ ID NO: 7771 |
| F11 | SEQ ID NO: 5719 and SEQ ID NO: 5499 and SEQ ID NO: 7739 |
| F12 | SEQ ID NO: 5719 and SEQ ID NO: 5499 and SEQ ID NO: 7785 |
| F13 | SEQ ID NO: 5694 and SEQ ID NO: 5496 and SEQ ID NO: 7769 |
| F14 | SEQ ID NO: 5694 and SEQ ID NO: 5496 and SEQ ID NO: 7771 |
| F15 | SEQ ID NO: 5694 and SEQ ID NO: 5496 and SEQ ID NO: 7739 |
| F16 | SEQ ID NO: 5694 and SEQ ID NO: 5496 and SEQ ID NO: 7785 |
| F17 | SEQ ID NO: 5694 and SEQ ID NO: 5498 and SEQ ID NO: 7769 |
| F18 | SEQ ID NO: 5694 and SEQ ID NO: 5498 and SEQ ID NO: 7771 |
| F19 | SEQ ID NO: 5694 and SEQ ID NO: 5498 and SEQ ID NO: 7739 |
| F20 | SEQ ID NO: 5694 and SEQ ID NO: 5498 and SEQ ID NO: 7785 |
| F21 | SEQ ID NO: 5694 and SEQ ID NO: 5499 and SEQ ID NO: 7769 |
| F22 | SEQ ID NO: 5694 and SEQ ID NO: 5499 and SEQ ID NO: 7771 |
| F23 | SEQ ID NO: 5694 and SEQ ID NO: 5499 and SEQ ID NO: 7739 |
| F24 | SEQ ID NO: 5694 and SEQ ID NO: 5499 and SEQ ID NO: 7785 |
| F25 | SEQ ID NO: 5706 and SEQ ID NO: 5496 and SEQ ID NO: 7769 |
| F26 | SEQ ID NO: 5706 and SEQ ID NO: 5496 and SEQ ID NO: 7771 |
| F27 | SEQ ID NO: 5706 and SEQ ID NO: 5496 and SEQ ID NO: 7739 |
| F28 | SEQ ID NO: 5706 and SEQ ID NO: 5496 and SEQ ID NO: 7785 |
| F29 | SEQ ID NO: 5706 and SEQ ID NO: 5498 and SEQ ID NO: 7769 |
| F30 | SEQ ID NO: 5706 and SEQ ID NO: 5498 and SEQ ID NO: 7771 |

TABLE 38-continued

Examples of preferred targeting domains of first, second and third gRNA molecules that can be used in combination to reduce or eliminate expression of TRBC, B2M and CIITA in a cell (as described herein).

| Combination Number | SEQ ID NO: s of targeting domains of first gRNA, second gRNA and third gRNA, respectively |
|---|---|
| F31 | SEQ ID NO: 5706 and SEQ ID NO: 5498 and SEQ ID NO: 7739 |
| F32 | SEQ ID NO: 5706 and SEQ ID NO: 5498 and SEQ ID NO: 7785 |
| F33 | SEQ ID NO: 5706 and SEQ ID NO: 5499 and SEQ ID NO: 7769 |
| F34 | SEQ ID NO: 5706 and SEQ ID NO: 5499 and SEQ ID NO: 7771 |
| F35 | SEQ ID NO: 5706 and SEQ ID NO: 5499 and SEQ ID NO: 7739 |
| F36 | SEQ ID NO: 5706 and SEQ ID NO: 5499 and SEQ ID NO: 7785 |
| F37 | SEQ ID NO: 5696 and SEQ ID NO: 5496 and SEQ ID NO: 7769 |
| F38 | SEQ ID NO: 5696 and SEQ ID NO: 5496 and SEQ ID NO: 7771 |
| F39 | SEQ ID NO: 5696 and SEQ ID NO: 5496 and SEQ ID NO: 7739 |
| F40 | SEQ ID NO: 5696 and SEQ ID NO: 5496 and SEQ ID NO: 7785 |
| F41 | SEQ ID NO: 5696 and SEQ ID NO: 5498 and SEQ ID NO: 7769 |
| F42 | SEQ ID NO: 5696 and SEQ ID NO: 5498 and SEQ ID NO: 7771 |
| F43 | SEQ ID NO: 5696 and SEQ ID NO: 5498 and SEQ ID NO: 7739 |
| F44 | SEQ ID NO: 5696 and SEQ ID NO: 5498 and SEQ ID NO: 7785 |
| F45 | SEQ ID NO: 5696 and SEQ ID NO: 5499 and SEQ ID NO: 7769 |
| F46 | SEQ ID NO: 5696 and SEQ ID NO: 5499 and SEQ ID NO: 7771 |
| F47 | SEQ ID NO: 5696 and SEQ ID NO: 5499 and SEQ ID NO: 7739 |
| F48 | SEQ ID NO: 5696 and SEQ ID NO: 5499 and SEQ ID NO: 7785 |
| F49 | SEQ ID NO: 5711 and SEQ ID NO: 5496 and SEQ ID NO: 7769 |
| F50 | SEQ ID NO: 5711 and SEQ ID NO: 5496 and SEQ ID NO: 7771 |
| F51 | SEQ ID NO: 5711 and SEQ ID NO: 5496 and SEQ ID NO: 7739 |
| F52 | SEQ ID NO: 5711 and SEQ ID NO: 5496 and SEQ ID NO: 7785 |
| F53 | SEQ ID NO: 5711 and SEQ ID NO: 5498 and SEQ ID NO: 7769 |
| F54 | SEQ ID NO: 5711 and SEQ ID NO: 5498 and SEQ ID NO: 7771 |
| F55 | SEQ ID NO: 5711 and SEQ ID NO: 5498 and SEQ ID NO: 7739 |
| F56 | SEQ ID NO: 5711 and SEQ ID NO: 5498 and SEQ ID NO: 7785 |
| F57 | SEQ ID NO: 5711 and SEQ ID NO: 5499 and SEQ ID NO: 7769 |
| F58 | SEQ ID NO: 5711 and SEQ ID NO: 5499 and SEQ ID NO: 7771 |
| F59 | SEQ ID NO: 5711 and SEQ ID NO: 5499 and SEQ ID NO: 7739 |
| F60 | SEQ ID NO: 5711 and SEQ ID NO: 5499 and SEQ ID NO: 7785 |

Particularly preferred combinations include combination F1 to F4, combination F5 to F8, combination F13 to F16, or combination F17 to F20.

As described herein, it is contemplated to generate a cell (or population of cells), e.g., an immune effector cell, e.g., a CAR-expressing immune effector cell, e.g., as described herein, which has reduced or eliminated expression of CD3E and FKBP1A. While it is contemplated that gRNAs comprising any targeting domain disclosed herein to each of these targets may be used in combination, particularly preferred targeting domain sequences to be used, for example, in combination are provided in the Table below. In embodiments, each of the gRNA molecules are provided in dual guide RNA format and include a crRNA comprising, e.g., consisting of, the sequence [targeting domain]-SEQ ID NO: 6607, and a tracr comprising, e.g., consisting of, the sequence of SEQ ID NO: 6660. In other embodiments, each of the gRNA molecules are provided in single guide RNA format comprising, e.g., consisting of, the sequence: [targeting domain]-SEQ ID NO: 6601. In other embodiments, each of the gRNA molecules are provided in single guide RNA format comprising, e.g., consisting of, the sequence: [targeting domain]-SEQ ID NO: 7811. In embodiments, one or more of the gRNA molecules, e.g., all of the gRNA molecules, additionally comprise one or more modifications described herein, e.g., comprise one or more, e.g., 3, 3' and/or 5' phosphorothioate bonds, and/or one or more, e.g., 3, 3' and/or 5' 2'-OMe modifications. In embodiments, each of the gRNA molecules is complexed with a Cas9 molecule (e.g., described herein) and delivered to the cell (or population of cells) as RNP, e.g., by electroporation. In embodiments, the RNP comprising each gRNA molecule are mixed with the cells and introduced simultaneously, e.g., by a single electroporation step. In other embodiments, the RNP may be introduced sequentially.

TABLE 35

Examples of preferred targeting domains of first, second and (optionally) third gRNA molecules that can be used in combination to reduce or eliminate expression of CD3E and FKBP1A in a cell (as described herein).

| Combination Number | SEQ ID NO: s of targeting domains of first gRNA, second, gRNA and, optionally, third gRNA respectively |
|---|---|
| C1 | SEQ ID NO: 10729 and SEQ ID NO: 6693 |
| C2 | SEQ ID NO: 10729 and SEQ ID NO: 6705 |
| C3 | SEQ ID NO: 10729 and SEQ ID NO: 6694 |
| C4 | SEQ ID NO: 10729 and SEQ ID NO: 6708 |
| C5 | SEQ ID NO: 10729 and SEQ ID NO: 6699 |
| C6 | SEQ ID NO: 10729 and SEQ ID NO: 6705 and SEQ ID NO: 6694 |
| C7 | SEQ ID NO: 10719 and SEQ ID NO: 6693 |
| C8 | SEQ ID NO: 10719 and SEQ ID NO: 6705 |
| C9 | SEQ ID NO: 10719 and SEQ ID NO: 6694 |
| C10 | SEQ ID NO: 10719 and SEQ ID NO: 6708 |
| C11 | SEQ ID NO: 10719 and SEQ ID NO: 6699 |
| C12 | SEQ ID NO: 10719 and SEQ ID NO: 6705 and SEQ ID NO: 6694 |
| C13 | SEQ ID NO: 10764 and SEQ ID NO: 6693 |
| C14 | SEQ ID NO: 10764 and SEQ ID NO: 6705 |
| C15 | SEQ ID NO: 10764 and SEQ ID NO: 6694 |
| C16 | SEQ ID NO: 10764 and SEQ ID NO: 6708 |
| C17 | SEQ ID NO: 10764 and SEQ ID NO: 6699 |

TABLE 35-continued

Examples of preferred targeting domains of first, second and (optionally) third gRNA molecules that can be used in combination to reduce or eliminate expression of CD3E and FKBP1A in a cell (as described herein).

| Combination Number | SEQ ID NO: s of targeting domains of first gRNA, second, gRNA and, optionally, third gRNA respectively |
|---|---|
| C18 | SEQ ID NO: 10764 and SEQ ID NO: 6705 and SEQ ID NO: 6694 |
| C19 | SEQ ID NO: 10689 and SEQ ID NO: 6693 |
| C20 | SEQ ID NO: 10689 and SEQ ID NO: 6705 |
| C21 | SEQ ID NO: 10689 and SEQ ID NO: 6694 |
| C22 | SEQ ID NO: 10689 and SEQ ID NO: 6708 |
| C23 | SEQ ID NO: 10689 and SEQ ID NO: 6699 |
| C24 | SEQ ID NO: 10689 and SEQ ID NO: 6705 and SEQ ID NO: 6694 |
| C25 | SEQ ID NO: 10701 and SEQ ID NO: 6693 |
| C26 | SEQ ID NO: 10701 and SEQ ID NO: 6705 |
| C27 | SEQ ID NO: 10701 and SEQ ID NO: 6694 |
| C28 | SEQ ID NO: 10701 and SEQ ID NO: 6708 |
| C29 | SEQ ID NO: 10701 and SEQ ID NO: 6699 |
| C30 | SEQ ID NO: 10701 and SEQ ID NO: 6705 and SEQ ID NO: 6694 |
| C31 | SEQ ID NO: 10700 and SEQ ID NO: 6693 |
| C32 | SEQ ID NO: 10700 and SEQ ID NO: 6705 |
| C33 | SEQ ID NO: 10700 and SEQ ID NO: 6694 |
| C34 | SEQ ID NO: 10700 and SEQ ID NO: 6708 |
| C35 | SEQ ID NO: 10700 and SEQ ID NO: 6699 |
| C36 | SEQ ID NO: 10700 and SEQ ID NO: 6705 and SEQ ID NO: 6694 |
| C37 | SEQ ID NO: 10722 and SEQ ID NO: 6693 |
| C38 | SEQ ID NO: 10722 and SEQ ID NO: 6705 |
| C39 | SEQ ID NO: 10722 and SEQ ID NO: 6694 |
| C40 | SEQ ID NO: 10722 and SEQ ID NO: 6708 |
| C41 | SEQ ID NO: 10722 and SEQ ID NO: 6699 |
| C42 | SEQ ID NO: 10722 and SEQ ID NO: 6705 and SEQ ID NO: 6694 |

As described herein, it is contemplated to generate a cell (or population of cells), e.g., an immune effector cell, e.g., a CAR-expressing immune effector cell, e.g., as described herein, which has reduced or eliminated expression of TRAC and FKBP1A. While it is contemplated that gRNAs comprising any targeting domain disclosed herein to each of these targets may be used in combination, particularly preferred targeting domain sequences to be used, for example, in combination are provided in the Table 36 below. In embodiments, each of the gRNA molecules are provided in dual guide RNA format and include a crRNA comprising, e.g., consisting of, the sequence [targeting domain]-SEQ ID NO: 6607, and a tracr comprising, e.g., consisting of, the sequence of SEQ ID NO: 6660. In other embodiments, each of the gRNA molecules are provided in single guide RNA format comprising, e.g., consisting of, the sequence: [targeting domain]-SEQ ID NO: 6601. In other embodiments, each of the gRNA molecules are provided in single guide RNA format comprising, e.g., consisting of, the sequence: [targeting domain]-SEQ ID NO: 7811. In embodiments, one or more of the gRNA molecules, e.g., all of the gRNA molecules, additionally comprise one or more modifications described herein, e.g., comprise one or more, e.g., 3, 3' and/or 5' phosphorothioate bonds, and/or one or more, e.g., 3, 3' and/or 5' 2'-OMe modifications. In embodiments, each of the gRNA molecules is complexed with a Cas9 molecule (e.g., described herein) and delivered to the cell (or population of cells, e.g., as described herein) as RNP, e.g., by electroporation. In embodiments, the RNP comprising each gRNA molecule are mixed with the cells and introduced simultaneously, e.g., by a single electroporation step. In other embodiments, the RNP may be introduced sequentially.

TABLE 36

Examples of preferred targeting domains of first, second and (optionally) third gRNA molecules that can be used in combination to reduce or eliminate expression of TRAC and FKBP1A in a cell (as described herein).

| Combination Number | SEQ ID NO: s of targeting domains of first gRNA, second gRNA and, optionally, third gRNA, respectively |
|---|---|
| D1 | SEQ ID NO: 5569 and SEQ ID NO: 6693 |
| D2 | SEQ ID NO: 5569 and SEQ ID NO: 6705 |
| D3 | SEQ ID NO: 5569 and SEQ ID NO: 6694 |
| D4 | SEQ ID NO: 5569 and SEQ ID NO: 6708 |
| D5 | SEQ ID NO: 5569 and SEQ ID NO: 6699 |
| D6 | SEQ ID NO: 5569 and SEQ ID NO: 6705 and SEQ ID NO: 6694 |
| D7 | SEQ ID NO: 5586 and SEQ ID NO: 6693 |
| D8 | SEQ ID NO: 5586 and SEQ ID NO: 6705 |
| D9 | SEQ ID NO: 5586 and SEQ ID NO: 6694 |
| D10 | SEQ ID NO: 5586 and SEQ ID NO: 6708 |
| D11 | SEQ ID NO: 5586 and SEQ ID NO: 6699 |
| D12 | SEQ ID NO: 5586 and SEQ ID NO: 6705 and SEQ ID NO: 6694 |
| D13 | SEQ ID NO: 5587 and SEQ ID NO: 6693 |
| D14 | SEQ ID NO: 5587 and SEQ ID NO: 6705 |
| D15 | SEQ ID NO: 5587 and SEQ ID NO: 6694 |
| D16 | SEQ ID NO: 5587 and SEQ ID NO: 6708 |
| D17 | SEQ ID NO: 5587 and SEQ ID NO: 6699 |
| D18 | SEQ ID NO: 5587 and SEQ ID NO: 6705 and SEQ ID NO: 6694 |
| D19 | SEQ ID NO: 5592 and SEQ ID NO: 6693 |
| D20 | SEQ ID NO: 5592 and SEQ ID NO: 6705 |
| D21 | SEQ ID NO: 5592 and SEQ ID NO: 6694 |
| D22 | SEQ ID NO: 5592 and SEQ ID NO: 6708 |
| D23 | SEQ ID NO: 5592 and SEQ ID NO: 6699 |
| D24 | SEQ ID NO: 5592 and SEQ ID NO: 6705 and SEQ ID NO: 6694 |
| D25 | SEQ ID NO: 5599 and SEQ ID NO: 6693 |

TABLE 36-continued

Examples of preferred targeting domains of first, second and (optionally) third gRNA molecules that can be used in combination to reduce or eliminate expression of TRAC and FKBP1A in a cell (as described herein).

| Combination Number | SEQ ID NO: s of targeting domains of first gRNA, second gRNA and, optionally, third gRNA, respectively |
|---|---|
| D26 | SEQ ID NO: 5599 and SEQ ID NO: 6705 |
| D27 | SEQ ID NO: 5599 and SEQ ID NO: 6694 |
| D28 | SEQ ID NO: 5599 and SEQ ID NO: 6708 |
| D29 | SEQ ID NO: 5599 and SEQ ID NO: 6699 |
| D30 | SEQ ID NO: 5599 and SEQ ID NO: 6705 and SEQ ID NO: 6694 |
| D31 | SEQ ID NO: 5600 and SEQ ID NO: 6693 |
| D32 | SEQ ID NO: 5600 and SEQ ID NO: 6705 |
| D33 | SEQ ID NO: 5600 and SEQ ID NO: 6694 |
| D34 | SEQ ID NO: 5600 and SEQ ID NO: 6708 |
| D35 | SEQ ID NO: 5600 and SEQ ID NO: 6699 |
| D36 | SEQ ID NO: 5600 and SEQ ID NO: 6705 and SEQ ID NO: 6694 |

Particularly preferred combinations include combination D2, combination D4, combination D20, or combination D22.

As described herein, it is contemplated to generate a cell (or population of cells), e.g., an immune effector cell, e.g., a CAR-expressing immune effector cell, e.g., as described herein, which has reduced or eliminated expression of TRBC and FKBP1A. While it is contemplated that gRNAs comprising any targeting domain disclosed herein to each of these targets may be used in combination, particularly preferred targeting domain sequences to be used, for example, in combination are provided in the Table 37 below. In embodiments, each of the gRNA molecules are provided in dual guide RNA format and include a crRNA comprising, e.g., consisting of, the sequence [targeting domain]-SEQ ID NO: 6607, and a tracr comprising, e.g., consisting of, the sequence of SEQ ID NO: 6660. In other embodiments, each of the gRNA molecules are provided in single guide RNA format comprising, e.g., consisting of, the sequence: [targeting domain]-SEQ ID NO: 6601. In other embodiments, each of the gRNA molecules are provided in single guide RNA format comprising, e.g., consisting of, the sequence: [targeting domain]-SEQ ID NO: 7811. In embodiments, one or more of the gRNA molecules, e.g., all of the gRNA molecules, additionally comprise one or more modifications described herein, e.g., comprise one or more, e.g., 3, 3' and/or 5' phosphorothioate bonds, and/or one or more, e.g., 3, 3' and/or 5' 2'-OMe modifications. In embodiments, each of the gRNA molecules is complexed with a Cas9 molecule (e.g., described herein) and delivered to the cell (or population of cells) as RNP, e.g., by electroporation. In embodiments, the RNP comprising each gRNA molecule are mixed with the cells and introduced simultaneously, e.g., by a single electroporation step. In other embodiments, the RNP may be introduced sequentially.

TABLE 37

Examples of preferred targeting domains of first, second and (optionally) third gRNA molecules that can be used in combination to reduce or eliminate expression of TRBC and FKBP1A in a cell (as described herein).

| Combination Number | SEQ ID NO: s of targeting domains of first gRNA, second gRNA and, optionally third gRNA, respectively |
|---|---|
| E1 | SEQ ID NO: 5719 and SEQ ID NO: 6693 |
| E2 | SEQ ID NO: 5719 and SEQ ID NO: 6705 |
| E3 | SEQ ID NO: 5719 and SEQ ID NO: 6694 |
| E4 | SEQ ID NO: 5719 and SEQ ID NO: 6708 |
| E5 | SEQ ID NO: 5719 and SEQ ID NO: 6699 |
| E6 | SEQ ID NO: 5719 and SEQ ID NO: 6705 and SEQ ID NO: 6694 |
| E7 | SEQ ID NO: 5694 and SEQ ID NO: 6693 |
| E8 | SEQ ID NO: 5694 and SEQ ID NO: 6705 |
| E9 | SEQ ID NO: 5694 and SEQ ID NO: 6694 |
| E10 | SEQ ID NO: 5694 and SEQ ID NO: 6708 |
| E11 | SEQ ID NO: 5694 and SEQ ID NO: 6699 |
| E12 | SEQ ID NO: 5694 and SEQ ID NO: 6705 and SEQ ID NO: 6694 |
| E13 | SEQ ID NO: 5706 and SEQ ID NO: 6693 |
| E14 | SEQ ID NO: 5706 and SEQ ID NO: 6705 |
| E15 | SEQ ID NO: 5706 and SEQ ID NO: 6694 |
| E16 | SEQ ID NO: 5706 and SEQ ID NO: 6708 |
| E17 | SEQ ID NO: 5706 and SEQ ID NO: 6699 |
| E18 | SEQ ID NO: 5706 and SEQ ID NO: 6705 and SEQ ID NO: 6694 |
| E19 | SEQ ID NO: 5696 and SEQ ID NO: 6693 |
| E20 | SEQ ID NO: 5696 and SEQ ID NO: 6705 |
| E21 | SEQ ID NO: 5696 and SEQ ID NO: 6694 |
| E22 | SEQ ID NO: 5696 and SEQ ID NO: 6708 |
| E23 | SEQ ID NO: 5696 and SEQ ID NO: 6699 |
| E24 | SEQ ID NO: 5696 and SEQ ID NO: 6705 and SEQ ID NO: 6694 |
| E25 | SEQ ID NO: 5711 and SEQ ID NO: 6693 |
| E26 | SEQ ID NO: 5711 and SEQ ID NO: 6705 |
| E27 | SEQ ID NO: 5711 and SEQ ID NO: 6694 |
| E28 | SEQ ID NO: 5711 and SEQ ID NO: 6708 |
| E29 | SEQ ID NO: 5711 and SEQ ID NO: 6699 |
| E30 | SEQ ID NO: 5711 and SEQ ID NO: 6705 and SEQ ID NO: 6694 |

Particularly preferred combinations include combination E2, combination E4, combination E8, or combination E10.

While not intending to be bound by theory, it has also been surprisingly shown herein that the targeting of two or more target sequences located within different genes may induce mutations (e.g., insertions or deletions or one or more nucleic acid residues) at each of the targeted sites, thereby reducing or eliminating expression of two or more proteins within the cell. Combinations of gRNAs targeting two or more different genes of interest are described herein.

As described herein, when utilizing more than one gRNA molecule (or CRISPR system comprising more than one gRNA molecule, e.g., a CRISPR system comprising a first gRNA molecule and a CRISPR system comprising a second gRNA molecule, e.g., wherein each gRNA molecule is complexed with a Cas molecule, e.g., a Cas9 molecule, e.g., as described herein), the more than one gRNA molecules may be introduced into a cell simultaneously, e.g., in a single introduction step, e.g., a single electroporation step. Alternatively, the more than one gRNA molecules (or CRISPR systems comprising said gRNA molecules) can be introduced into a cell in more than one steps, e.g., more than one electroporations. If multiple introduction steps are utilized, the steps may be separated by a period of hours, days, or weeks, e.g., by a period of 1 hour, 2 hours, 5 hours, 10 hours, 15 hours, 20 hours, 24 hours, 2 days, 3, days, 4 days, 5 days, 6 days, 7 days, 8 days, 9 days, 10 days, or more.

IX. Properties of the gRNA

It has further been surprisingly shown herein that gRNA molecules and CRISPR systems comprising said gRNA molecules produce similar or identical indel patterns in different cell types, across different methods of delivery and using different crRNA/tracr components. Without being bound by theory, it is believed that some indel patterns may be more advantageous than others. For example, indels which predominantly include insertions and/or deletions which result in a "frameshift mutation" (e.g., 1- or 2-base pair insertion or deletions, or any insertion or deletion where n/3 is not a whole number (where n=the number of nucleotides in the insertion or deletion)) may be beneficial in reducing or eliminating expression of a functional protein. Likewise, indels which predominantly include "large deletions" (deletions of more than 10, 11, 12, 13, 14, 15, 20, 25, or 30 nucleotides) may also be beneficial in, for example, removing critical regulatory sequences such as promoter binding sites, which may similarly have an improved effect on expression of functional protein. While the indel patterns induced by a given gRNA/CRISPR system have surprisingly been found to be consistently reproduced across cell types, as described herein, not any single indel structure will inevitably be produced in a given cell upon introduction of a gRNA/CRISPR system.

The invention thus provides for gRNA molecules which create a beneficial indel pattern or structure, for example, which have indel patterns or structures predominantly composed of frameshift mutation(s) and/or large deletions. Such gRNA molecules may be selected by assessing the indel pattern or structure created by a candidate gRNA molecule in a test cell (for example, a HEK293 cell or in the cell of interest, e.g., a T cell) by NGS, as described herein. As shown in the Examples, gRNA molecules have been discovered, which, when introduced into the desired cell population, result in a population of cells comprising a significant fraction of the cells having a frameshift mutation in the targeted gene. In some cases, the rate of frameshift mutation is as high as 75%, 80%, 85%, 90% or more. The invention thus provides for populations of cells which comprise at least about 40% of cells (e.g., at least about 45%, at least about 50%, at least about 55%, at least about 60%, at least about 65%, at least about 70%, at least about 75%, at least about 80%, at least about 85%, at least about 90%, at least about 95%, or at least about 99%) having a frameshift mutation, e.g., as described herein, at or near the target site of a gRNA molecule described herein. The invention also provides for populations of cells which comprise at least about 50% of cells (e.g., at least about 55%, at least about 60%, at least about 65%, at least about 70%, at least about 75%, at least about 80%, at least about 85%, at least about 90%, at least about 95%, or at least about 99%) having a frameshift mutation, e.g., as described herein, at or near the target site of a gRNA molecule described herein.

The invention thus provides methods of selecting gRNA molecules for use in the therapeutic methods of the invention comprising: 1) providing a plurality of gRNA molecules to a target of interest, 2) assessing the indel pattern or structure created by use of said gRNA molecules, 3) selecting a gRNA molecule that forms an indel pattern or structure composed predominantly of frameshift mutations, large deletions or a combination thereof, and 4) using said selected gRNA in a methods of the invention.

The invention further provides methods of altering cells, and altered cells, wherein a particular indel pattern is consistently produced with a given gRNA/CRISPR system in that cell type. The indel patterns, including the top 5 most frequently occurring indels observed with the gRNA/CRISPR systems described herein are disclosed, for example, in the Examples. As shown in the examples, populations of cells are generated, wherein a significant fraction of the cells comprises one of the top 5 indels (for example, populations of cells wherein one of the top 5 indels is present in more than 30%, more than 40%, more than 50%, more than 60% or more of the cells of the population. Thus, the invention provides cells, e.g., immune effector cells, e.g., CAR-expressing immune effector cells (as described herein), which comprise an indel of any one of the top 5 indels observed with a given gRNA/CRISPR system. Further, the invention provides populations of cells, e.g., immune effector cells, e.g., CAR-expressing immune effector cells (as described herein), which when assessed by, for example, NGS, comprise a high percentage of cells comprising one of the top 5 indels described herein for a given gRNA/CRISPR system. When used in connection with indel pattern analysis, a "high percentage" refers to at least about 50% (e.g., at least about 55%, at least about 60%, at least about 65%, at least about 70%, at least about 75%, at least about 80%, at least about 85%, at least about 90%, at least about 95%, or at least about 99%) of the cells of the population comprising one of the top 5 indels described herein for a given gRNA/CRISPR system. In other embodiments, the population of cells comprises at least about 25% (e.g., from about 25% to about 60%, e.g., from about 25% to about 50%, e.g., from about 25% to about 40%, e.g., from about 25% to about 35%) of cells which have one of the top 5 indels described herein for a given gRNA/CRISPR system. In embodiments, the top 5 indels for a given gRNA/CRISPR system which targets TRAC are provided in FIG. 34A, FIG. 34B and FIG. 49. In embodiments, the top 5 indels for a given gRNA/CRISPR system which targets B2M are provided in FIG. 36 and FIG. 48. In embodiments, the top 5 indels for a given gRNA/CRISPR system which targets CIITA are provided in FIG. 38, FIG. 41, FIG. 44, and FIG. 50. In embodiments, the top 5 indels for a given gRNA/CRISPR system which targets FKBP1A are provided in FIG. 53.

It has also been discovered that certain gRNA molecules do not create indels at off-target sequences within the genome of the target cell type, or produce indels at off target sites at very low frequencies (e.g., <5% of cells within a population) relative to the frequency of indel creation at the target site. Thus, the invention provides for gRNA molecules and CRISPR systems which do not exhibit off-target indel formation in the target cell type, or which produce a frequency of off-target indel formation of <5%. In embodiments, the invention provides gRNA molecules and CRISPR systems which do not exhibit any off target indel formation in the target cell type. Thus, the invention further provides a cell, e.g., a population of cells, e.g., immune effector cells, e.g., CAR-expressing immune effector cells, e.g., as described herein, which comprise an indel at or near a target site of a gRNA molecule described herein (e.g., a frameshift indel, or any one of the top 5 indels produced by a given gRNA/CRISPR system, e.g., as described herein), but does not comprise an indel at any off-target site of the gRNA molecule. In other embodiments, the invention further provides a population of cells, e.g., immune effector cells, e.g., CAR-expressing immune effector cells, e.g., as described herein, which comprises >50% of cells which have an indel at or near a target site of a gRNA molecule described herein (e.g., a frameshift indel, or any one of the top 5 indels produced by a given gRNA/CRISPR system, e.g., as described herein), but which comprises less than 5%, e.g., less than 4%, less than 3%, less than 2% or less than 1%, of cells comprising an indel at any off-target site of the gRNA molecule.

X. Delivery/Constructs

The components, e.g., a Cas9 molecule or gRNA molecule, or both, can be delivered, formulated, or administered in a variety of forms. As a non-limiting example, the gRNA molecule and Cas9 molecule can be formulated (in one or more compositions), directly delivered or administered to a cell in which a genome editing event is desired. Alternatively, nucleic acid encoding one or more components, e.g., a Cas9 molecule or gRNA molecule, or both, can be formulated (in one or more compositions), delivered or administered. In one aspect, the gRNA molecule is provided as DNA encoding the gRNA molecule and the Cas9 molecule is provided as DNA encoding the Cas9 molecule. In one embodiment, the gRNA molecule and Cas9 molecule are encoded on separate nucleic acid molecules. In one embodiment, the gRNA molecule and Cas9 molecule are encoded on the same nucleic acid molecule. In one aspect, the gRNA molecule is provided as RNA and the Cas9 molecule is provided as DNA encoding the Cas9 molecule. In one embodiment, the gRNA molecule is provided with one or more modifications, e.g., as described herein. In one aspect, the gRNA molecule is provided as RNA and the Cas9 molecule is provided as mRNA encoding the Cas9 molecule. In one aspect, the gRNA molecule is provided as RNA and the Cas9 molecule is provided as a protein. In one embodiment, the gRNA and Cas9 molecule are provided as a ribonuclear protein complex (RNP). In one aspect, the gRNA molecule is provided as DNA encoding the gRNA molecule and the Cas9 molecule is provided as a protein.

Delivery may be accomplished by, for example, electroporation (e.g., as known in the art) or other method that renders the cell membrane permeable to nucleic acid and/or polypeptide molecules. Additional techniques for rendering the membrane permeable are known in the art and include, for example, cell squeezing (e.g., as described in WO2015/023982 and WO2013/059343, the contents of which are hereby incorporated by reference in their entirety), nanoneedles (e.g., as described in Chiappini et al., Nat. Mat., 14; 532-39, or US2014/0295558, the contents of which are hereby incorporated by reference in their entirety) and nanostraws (e.g., as described in Xie, ACS Nano, 7(5); 4351-58, the contents of which are hereby incorporated by reference in their entirety).

When a component is delivered encoded in DNA the DNA will typically include a control region, e.g., comprising a promoter, to effect expression. Useful promoters for Cas9 molecule sequences include CMV, EF-1 alpha, MSCV, PGK, CAG control promoters. Useful promoters for gRNAs include H1, EF-1a and U6 promoters. Promoters with similar or dissimilar strengths can be selected to tune the expression of components. Sequences encoding a Cas9 molecule can comprise a nuclear localization signal (NLS), e.g., an SV40 NLS. In an embodiment, a promoter for a Cas9 molecule or a gRNA molecule can be, independently, inducible, tissue specific, or cell specific.

DNA-Based Delivery of a Cas9 Molecule and or a gRNA Molecule

DNA encoding Cas9 molecules and/or gRNA molecules, can be administered to subjects or delivered into cells by art-known methods or as described herein. For example, Cas9-encoding and/or gRNA-encoding DNA can be delivered, e.g., by vectors (e.g., viral or non-viral vectors), non-vector based methods (e.g., using naked DNA or DNA complexes), or a combination thereof.

In some embodiments, the Cas9- and/or gRNA-encoding DNA is delivered by a vector (e.g., viral vector/virus, plasmid, minicircle or nanoplasmid).

A vector can comprise a sequence that encodes a Cas9 molecule and/or a gRNA molecule. A vector can also comprise a sequence encoding a signal peptide (e.g., for nuclear localization, nucleolar localization, mitochondrial localization), fused, e.g., to a Cas9 molecule sequence. For example, a vector can comprise one or more nuclear localization sequence (e.g., from SV40) fused to the sequence encoding the Cas9 molecule.

One or more regulatory/control elements, e.g., a promoter, an enhancer, an intron, a polyadenylation signal, a Kozak consensus sequence, internal ribosome entry sites (IRES), a 2A sequence, and a splice acceptor or donor can be included in the vectors. In some embodiments, the promoter is recognized by RNA polymerase II (e.g., a CMV promoter). In other embodiments, the promoter is recognized by RNA polymerase III (e.g., a U6 promoter). In some embodiments, the promoter is a regulated promoter (e.g., inducible promoter). In other embodiments, the promoter is a constitutive promoter. In some embodiments, the promoter is a tissue specific promoter. In some embodiments, the promoter is a viral promoter. In other embodiments, the promoter is a non-viral promoter.

In some embodiments, the vector or delivery vehicle is a minicircle. In some embodiments, the vector or delivery vehicle is a nanoplasmid.

In some embodiments, the vector or delivery vehicle is a viral vector (e.g., for generation of recombinant viruses). In some embodiments, the virus is a DNA virus (e.g., dsDNA or ssDNA virus). In other embodiments, the virus is an RNA virus (e.g., an ssRNA virus).

Exemplary viral vectors/viruses include, e.g., retroviruses, lentiviruses, adenovirus, adeno-associated virus (AAV), vaccinia viruses, poxviruses, and herpes simplex viruses. Viral vector technology is well known in the art and is described, for example, in Sambrook et al., 2012, MOLECULAR CLONING: A LABORATORY MANUAL, volumes 1-4, Cold Spring Harbor Press, NY), and in other virology and molecular biology manuals.

In some embodiments, the virus infects dividing cells. In other embodiments, the virus infects non-dividing cells. In some embodiments, the virus infects both dividing and non-dividing cells. In some embodiments, the virus can integrate into the host genome. In some embodiments, the virus is engineered to have reduced immunity, e.g., in human. In some embodiments, the virus is replication-competent. In other embodiments, the virus is replication-defective, e.g., having one or more coding regions for the genes necessary for additional rounds of virion replication and/or packaging replaced with other genes or deleted. In some embodiments, the virus causes transient expression of the Cas9 molecule and/or the gRNA molecule. In other embodiments, the virus causes long-lasting, e.g., at least 1 week, 2 weeks, 1 month, 2 months, 3 months, 6 months, 9 months, 1 year, 2 years, or permanent expression, of the Cas9 molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, kb, or 50 kb.

In some embodiments, the Cas9- and/or gRNA-encoding DNA is delivered by a recombinant retrovirus. In some embodiments, the retrovirus (e.g., Moloney murine leukemia vims) comprises a reverse transcriptase, e.g., that allows integration into the host genome. In some embodiments, the retrovirus is replication-competent. In other embodiments, the retrovirus is replication-defective, e.g., having one of more coding regions for the genes necessary for additional rounds of virion replication and packaging replaced with other genes, or deleted.

In some embodiments, the Cas9- and/or gRNA-encoding DNA is delivered by a recombinant lentivirus. For example, the lentivirus is replication-defective, e.g., does not comprise one or more genes required for viral replication.

In some embodiments, the Cas9- and/or gRNA-encoding DNA is delivered by a recombinant adenovirus. In some embodiments, the adenovirus is engineered to have reduced immunity in human.

In some embodiments, the Cas9- and/or gRNA-encoding DNA is delivered by a recombinant AAV. In some embodiments, the AAV can incorporate its genome into that of a host cell, e.g., a target cell as described herein. In some embodiments, the AAV is a self-complementary adeno-associated virus (scAAV), e.g., a scAAV that packages both strands which anneal together to form double stranded DNA. AAV serotypes that may be used in the disclosed methods include, e.g., AAV1, AAV2, modified AAV2 (e.g., modifications at Y444F, Y500F, Y730F and/or S662V), AAV3, modified AAV3 (e.g., modifications at Y705F, Y731F and/or. T492V), AAV4, AAV5, AAV6, modified AAV6 (e.g., modifications at S663V and/or T492V), AAV8. AAV 8.2, AAV9, AAV rh 10, and pseudotyped AAV, such as AAV2/8, AAV2/5 and AAV2/6 can also be used in the disclosed methods.

In some embodiments, the Cas9- and/or gRNA-encoding DNA is delivered by a hybrid virus, e.g., a hybrid of one or more of the viruses described herein.

A Packaging cell is used to form a virus particle that is capable of infecting a host or target cell. Such a cell includes a 293 cell, which can package adenovirus, and a ψ2 cell or a PA317 cell, which can package retrovirus. A viral vector used in gene therapy is usually generated by a producer cell line that packages a nucleic acid vector into a viral particle. The vector typically contains the minimal viral sequences required for packaging and subsequent integration into a host or target cell (if applicable), with other viral sequences being replaced by an expression cassette encoding the protein to be expressed. For example, an AAV vector used in gene therapy typically only possesses inverted terminal repeat (ITR) sequences from the AAV genome which are required for packaging and gene expression in the host or target cell. The missing viral functions are supplied in trans by the packaging cell line. Henceforth, the viral DNA is packaged in a cell line, which contains a helper plasmid encoding the other AAV genes, namely rep and cap, but lacking ITR sequences. The cell line is also infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV.

In an embodiment, the viral vector has the ability of cell type and/or tissue type recognition. For example, the viral vector can be pseudotyped with a different/alternative viral envelope glycoprotein; engineered with a cell type-specific receptor (e.g., genetic modification of the viral envelope glycoproteins to incorporate targeting ligands such as a peptide ligand, a single chain antibodies, a growth factor); and/or engineered to have a molecular bridge with dual specificities with one end recognizing a viral glycoprotein and the other end recognizing a moiety of the target cell surface (e.g., ligand-receptor, monoclonal antibody, avidin-biotin and chemical conjugation).

In an embodiment, the viral vector achieves cell type specific expression. For example, a tissue-specific promoter can be constructed to restrict expression of the transgene (Cas 9 and gRNA) in only the target cell. The specificity of the vector can also be mediated by microRNA-dependent control of transgene expression. In an embodiment, the viral vector has increased efficiency of fusion of the viral vector and a target cell membrane. For example, a fusion protein such as fusion-competent hemagglutinin (HA) can be incorporated to increase viral uptake into cells. In an embodiment, the viral vector has the ability of nuclear localization. For example, a virus that requires the breakdown of the cell wall (during cell division) and therefore will not infect a non-diving cell can be altered to incorporate a nuclear localization peptide in the matrix protein of the virus thereby enabling the transduction of non-proliferating cells.

In some embodiments, the Cas9- and/or gRNA-encoding DNA is delivered by a non-vector based method (e.g., using naked DNA or DNA complexes). For example, the DNA can be delivered, e.g., by organically modified silica or silicate (Ormosil), electroporation, gene gun, sonoporation, magnetofection, lipid-mediated transfection, dendrimers, inorganic nanoparticles, calcium phosphates, or a combination thereof.

In some embodiments, the Cas9- and/or gRNA-encoding DNA is delivered by a combination of a vector and a non-vector based method. For example, a virosome comprises a liposome combined with an inactivated virus (e.g., HIV or influenza virus), which can result in more efficient gene transfer, e.g., in a respiratory epithelial cell than either a viral or a liposomal method alone.

In an embodiment, the delivery vehicle is a non-viral vector. In an embodiment, the non-viral vector is an inorganic nanoparticle (e.g., attached to the payload to the surface of the nanoparticle). Exemplary inorganic nanoparticles include, e.g., magnetic nanoparticles (e.g., Fe lvln0$_2$), or silica. The outer surface of the nanoparticle can be conjugated with a positively charged polymer (e.g., polyethylenimine, polylysine, polyserine) which allows for attachment (e.g., conjugation or entrapment) of payload. In an embodiment, the non-viral vector is an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating.

Exemplary lipids and/or polymers for transfer of CRISPR systems or nucleic acid, e.g., vectors, encoding CRISPR systems or components thereof include, for example, those described in WO2011/076807, WO2014/136086, WO2005/060697, WO2014/140211, WO2012/031046, WO2013/103467, WO2013/006825, WO2012/006378, WO2015/095340, and WO2015/095346, the contents of each of the foregoing are hereby incorporated by reference in their entirety. In an embodiment, the vehicle has targeting modifications to increase target cell update of nanoparticles and liposomes, e.g., cell specific antigens, monoclonal antibodies, single chain antibodies, aptamers, polymers, sugars, and cell penetrating peptides. In an embodiment, the vehicle uses fusogenic and endosome-destabilizing peptides/polymers. In an embodiment, the vehicle undergoes acid-triggered conformational changes (e.g., to accelerate endosomal escape of the cargo). In an embodiment, a stimuli-cleavable polymer is used, e.g., for release in a cellular compartment. For example, disulfide-based cationic polymers that are cleaved in the reducing cellular environment can be used.

In an embodiment, the delivery vehicle is a biological non-viral delivery vehicle. In an embodiment, the vehicle is an attenuated bacterium (e.g., naturally or artificially engineered to be invasive but attenuated to prevent pathogenesis and expressing the transgene (e.g., *Listeria monocytogenes*, certain *Salmonella* strains, *Bifidobacterium longum*, and modified *Escherichia coli*), bacteria having nutritional and tissue-specific tropism to target specific tissues, bacteria having modified surface proteins to alter target tissue specificity). In an embodiment, the vehicle is a genetically modified bacteriophage (e.g., engineered phages having large packaging capacity, less immunogenic, containing mammalian plasmid maintenance sequences and having incorporated targeting ligands). In an embodiment, the vehicle is a mammalian virus-like particle. For example, modified viral particles can be generated (e.g., by purification of the "empty" particles followed by ex vivo assembly of the virus with the desired cargo). The vehicle can also be engineered to incorporate targeting ligands to alter target tissue specificity. In an embodiment, the vehicle is a biological liposome. For example, the biological liposome is a phospholipid-based particle derived from human cells (e.g., erythrocyte ghosts, which are red blood cells broken down into spherical structures derived from the subject (e.g., tissue targeting can be achieved by attachment of various tissue or cell-specific ligands), or secretory exosomes—subject (i.e., patient) derived membrane-bound nanovesicle (30-100 nm) of endocytic origin (e.g., can be produced from various cell types and can therefore be taken up by cells without the need of for targeting ligands).

In an embodiment, one or more nucleic acid molecules (e.g., DNA molecules) other than the components of a Cas system, e.g., the Cas9 molecule component and/or the gRNA molecule component described herein, are delivered. In an embodiment, the nucleic acid molecule is delivered at the same time as one or more of the components of the Cas system are delivered. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas9 system are delivered. In an embodiment, the nucleic acid molecule is delivered by a different means than one or more of the components of the Cas9 system, e.g., the Cas9 molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component and/or the gRNA molecule component can be delivered by electroporation, e.g., such that the toxicity caused by nucleic acids (e.g., DNAs) can be reduced. In an embodiment, the nucleic acid molecule encodes a therapeutic protein, e.g., a protein described herein. In an embodiment, the nucleic acid molecule encodes an RNA molecule, e.g., an RNA molecule described herein.

Delivery of RNA encoding a Cas9 molecule

RNA encoding Cas9 molecules (e.g., active Cas9 molecules, inactive Cas9 molecules or inactive Cas9 fusion proteins) and/or gRNA molecules, can be delivered into cells, e.g., target cells described herein, by art-known methods or as described herein. For example, Cas9-encoding and/or gRNA-encoding RNA can be delivered, e.g., by microinjection, electroporation, lipid-mediated transfection, peptide-mediated delivery, or a combination thereof.

Delivery of Cas9 Molecule as Protein

Cas9 molecules (e.g., active Cas9 molecules, inactive Cas9 molecules or inactive Cas9 fusion proteins) can be delivered into cells by art-known methods or as described herein. For example, Cas9 protein molecules can be delivered, e.g., by microinjection, electroporation, lipid-mediated transfection, peptide-mediated delivery, cell squeezing or abrasion (e.g., by nanoneedles) or a combination thereof. Delivery can be accompanied by DNA encoding a gRNA or by a gRNA.

In an embodiment the Cas9 molecule, e.g., as described herein, is delivered as a protein and the gRNA molecule is delivered at one or more RNAs (e.g., as a dgRNA or sgRNA, as described herein). In embodiments, the Cas9 protein is complexed with the gRNA molecule prior to delivery to a cell, e.g., as described herein, as a ribonuclear protein complex ("RNP"). In embodiments, the RNP can be delivered into cells, e.g., described herein, by any art-known method, e.g., electroporation. As described herein, and without being bound by theory, it can be preferable to use a gRNA molecule and Cas9 molecule which result in high % editing at the target sequence (e.g., >85%, >90%, >95%, >98%, or >99%) in the target cell, e.g., described herein, even when the concentration of RNP delivered to the cell is reduced. Again, without being bound by theory, delivering a reduced or low concentration of RNP comprising a gRNA molecule that produces a high % editing at the target sequence in the target cell (including at the low RNP concentration), can be beneficial because it may reduce the frequency and number of off-target editing events. In one aspect, where a low or reduced concentration of RNP is to be used, the following procedure can be used to generate the RNP:

1. Provide the Cas9 molecule and the tracr in solution at a high concentration (e.g., a concentration higher than the final RNP concentration to be delivered to the cell), and allow the two components to equilibrate;
2. Provide the crRNA molecule, and allow the components to equilibrate (thereby forming a high-concentration solution of the RNP);
3. Dilute the RNP solution to the desired concentration;
4. Deliver said RNP at said desired concentration to the target cells, e.g., by electroporation.

The above procedure may be modified for use with sgRNA molecules by omitting step 2, above, and in step 1, providing the Cas9 molecule and the sgRNA molecule in solution at high concentration, and allowing the components to equilibrate. In embodiments, the Cas9 molecule and each gRNA component are provided in solution at a 1:2 ratio (Cas9:gRNA), e.g., a 1:2 molar ratio of Cas9:gRNA molecule. Where dgRNA molecules are used, the ratio, e.g., molar ratio, is 1:2:2 (Cas9:tracr:crRNA). In embodiments, the RNP is formed at a concentration of 20 uM or higher, e.g., a concentration from about to about 50 uM. In embodiments, the RNP is formed at a concentration of 10 uM or higher, e.g., a concentration from about 10 uM to about 30 uM. In embodiments, the RNP is diluted to a final concentration of 10 uM or less (e.g., a concentration from about 0.01 uM to about 10 uM) in a solution comprising the target cell (e.g., described herein) for delivery to said target cell. In embodiments, the RNP is diluted to a final concentration of 3 uM or less (e.g., a concentration from about 0.01 uM to about 3 uM) in a solution comprising the target cell (e.g., described herein) for delivery to said target cell. In embodiments, the RNP is diluted to a final concentration of 1 uM or less (e.g., a concentration from about 0.01 uM to about 1 uM) in a solution comprising the target cell (e.g., described herein) for delivery to said target cell. In embodiments, the RNP is diluted to a final concentration of 0.3 uM or less (e.g., a concentration from about 0.01 uM to about 0.3 uM) in a solution comprising the target cell (e.g., described herein) for delivery to said target cell. In embodiments, the RNP is provided at a final concentration of about 3 uM in a solution comprising the target cell (e.g., described herein) for delivery to said target cell. In embodiments, the RNP is provided at a final concentration of about 1 uM in a solution comprising the target cell (e.g., described herein) for delivery to said target cell. In embodiments, the RNP is provided at a final concentration of about 0.3 uM in a solution comprising the target cell (e.g., described herein) for delivery to said target cell. In embodiments, the RNP is provided at a final concentration of about 0.1 uM in a solution comprising the target cell (e.g., described herein) for delivery to said target cell. In embodiments, the RNP is provided at a final concentration of about 0.05 uM in a solution comprising the target cell (e.g., described herein) for delivery to said target cell. In embodiments, the RNP is provided at a final concentration of about 0.03 uM in a solution comprising the target cell (e.g., described herein) for delivery to said target cell. In embodiments, the RNP is provided at a final concentration of about 0.01 uM in a solution comprising the target cell (e.g., described herein) for delivery to said target cell.

Bi-Modal or Differential Delivery of Components

Separate delivery of the components of a Cas system, e.g., the Cas9 molecule component and the gRNA molecule component, and more particularly, delivery of the components by differing modes, can enhance performance, e.g., by improving tissue specificity and safety.

In an embodiment, the Cas9 molecule and the gRNA molecule are delivered by different modes, or as sometimes referred to herein as differential modes. Different or differential modes, as used herein, refer modes of delivery that confer different pharmacodynamic or pharmacokinetic properties on the subject component molecule, e.g., a Cas9 molecule, gRNA molecule, or template nucleic acid. For example, the modes of delivery can result in different tissue distribution, different half-life, or different temporal distribution, e.g., in a selected compartment, tissue, or organ.

Some modes of delivery, e.g., delivery by a nucleic acid vector that persists in a cell, or in progeny of a cell, e.g., by autonomous replication or insertion into cellular nucleic acid, result-in more persistent expression of and presence of a component.

XI. Methods of Treatment

The Cas systems, e.g., one or more gRNA molecules and one or more Cas molecules (e.g., Cas9 molecules), described herein are useful for the treatment of disease in a mammal, e.g., in a human. The terms "treat," "treated," "treating," and "treatment," include the administration of cas systems, e.g., one or more gRNA molecules and one or more Cas9 molecules, to cells to prevent or delay the onset of the symptoms, complications, or biochemical indicia of a disease, alleviating the symptoms or arresting or inhibiting further development of the disease, condition, or disorder. Treatment may be prophylactic (to prevent or delay the onset of the disease, or to prevent the manifestation of clinical or subclinical symptoms thereof) or therapeutic suppression or alleviation of symptoms after the manifestation of the disease. Treatment can be measured by the therapeutic measures described herein. The methods of "treatment" of the present invention also include administration of cells altered by the introduction of a cas system (e.g., one or more gRNA molecules and one or more Cas molecules) into said cells to a subject in order to cure, reduce the severity of, or ameliorate one or more symptoms of a disease or condition, in order to prolong the health or survival of a subject beyond that expected in the absence of such treatment. For example, "treatment" includes the alleviation of a disease symptom in a subject by at least 5%, 6%, 7%, 8%, 9%, 10%, 11%, 12%, 13%, 14%, 15%, 16%, 17%, 18%, 19%, 20%, 25%, 30%, 35%, 40%, 45%, 50%, 55%, 60%, 65%, 70%, 75%, 80%, 85%, 90%, 95% or more.

Methods of Treatment/Combination Therapies

In another aspect, the present invention provides a method comprising administering a cell of the invention, e.g., a cell which comprises or which at any time comprised a gRNA molecule as described herein, to a subject. In embodiments, the cell has been altered by the introduction of the gRNA molecule such that the gene comprising sequence complementary to the gRNA molecule targeting domain is altered, such that expression of functional product of that gene is reduced or eliminated relative to an unmodified cell. In embodiments, the cell is further engineered to express a CAR, e.g., as described herein. In embodiments, the cell is an immune effector cell, e.g., an NK cell or T cell. In embodiments, the cell is allogeneic. In embodiments, the cell is autologous.

In another aspect, the present invention provides a method comprising administering a gRNA molecule, e.g., a gRNA molecule described herein, or a cell comprising or which at any time comprised a gRNA molecule, e.g., a gRNA molecule described herein, to a subject in need thereof. In one embodiment, the subject has a disorder described herein, e.g., the subject has cancer, e.g., the subject has a cancer which expresses a target antigen described herein. In one embodiment, the subject is a human.

In another aspect, the invention pertains to a method of treating a subject having a disease associated with expression of a cancer associated antigen as described herein comprising administering to the subject an effective amount of a gRNA molecule, e.g., a gRNA molecule described herein, or a cell comprising or which at any time comprised a gRNA molecule, e.g., a gRNA molecule described herein.

In yet another aspect, the invention features a method of treating a subject having a disease associated with expression of a tumor antigen (e.g., an antigen described herein), comprising administering to the subject an effective amount of a cell, e.g., an immune effector cell (e.g., a population of immune effector cells) comprising or which at any time comprised a gRNA molecule, e.g., a gRNA molecule described herein, further comprising a CAR molecule, wherein the CAR molecule comprises an antigen binding domain, a transmembrane domain, and an intracellular domain, said intracellular domain comprises a costimulatory domain and/or a primary signaling domain, wherein said antigen binding domain binds to the tumor antigen associated with the disease, e.g. a tumor antigen as described herein.

In a related aspect, the invention features a method of treating a subject having a disease associated with expression of a tumor antigen. The method comprises administering to the subject an effective amount of a gRNA molecule, e.g., a gRNA molecule described herein, or a cell comprising or which at any time comprised a gRNA molecule, e.g., a gRNA molecule described herein, in combination with an agent that increases the efficacy of the cell, wherein:
the agent that increases the efficacy of the immune cell is chosen from one or more of:
a protein phosphatase inhibitor;
a kinase inhibitor;
a cytokine;
an inhibitor of an immune inhibitory molecule; or
an agent that decreases the level or activity of a TREE cell.

In another aspect, the invention features a composition comprising an immune effector cell (e.g., a population of immune effector cells) comprising or which at any time comprised a gRNA molecule, e.g., a gRNA molecule described herein, for use in the treatment of a subject having a disease associated with expression of a tumor antigen, e.g., a disorder as described herein.

In certain embodiments of any of the aforesaid methods or uses, the cell comprising or which at any time comprised a gRNA described herein, has been altered such that the expression of the functional gene product of the gene comprising the target sequence complementary to the gRNA targeting domain has been reduced or abolished. In an embodiment, expression of the functional gene product of the gene comprising the target sequence complementary to the gRNA targeting domain has been abolished. In embodiments, the cell further expresses a CAR, e.g., as described herein. In embodiments the cell is allogeneic. In embodiments, the cell is autologous.

In certain embodiments of any of the aforesaid methods or uses, the disease associated with a tumor antigen, e.g., a tumor antigen described herein, is selected from a proliferative disease such as a cancer or malignancy or a precancerous condition such as a myelodysplasia, a myelodysplastic syndrome or a preleukemia, or is a non-cancer related indication associated with expression of a tumor antigen described herein. In one embodiment, the disease is a cancer described herein, e.g., a cancer described herein as being associated with a target described herein. In one embodiment, the disease is a hematologic cancer. In one embodiment, the hematologic cancer is leukemia. In one embodiment, the cancer is selected from the group consisting of one or more acute leukemias including but not limited to B-cell acute lymphoid leukemia ("BALL"), T-cell acute lymphoid leukemia ("TALL"), acute lymphoid leukemia (ALL); one or more chronic leukemias including but not limited to chronic myelogenous leukemia (CML), chronic lymphocytic leukemia (CLL); additional hematologic cancers or hematologic conditions including, but not limited to B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin lymphoma, Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and to disease associated with expression of a tumor antigen described herein include, but not limited to, atypical and/or non-classical cancers, malignancies, precancerous conditions or proliferative diseases expressing a tumor antigen as described herein; and any combination thereof. In another embodiment, the disease associated with a tumor antigen described herein is a solid tumor.

In certain embodiments, the methods or uses are carried out in combination with an agent that increases the efficacy of the immune effector cell, e.g., an agent as described herein.

In any of the aforesaid methods or uses, the disease associated with expression of the tumor antigen is selected from the group consisting of a proliferative disease, a precancerous condition, a cancer, and a non-cancer related indication associated with expression of the tumor antigen.

The cancer can be a hematologic cancer, e.g., a cancer chosen from one or more of chronic lymphocytic leukemia (CLL), acute leukemias, acute lymphoid leukemia (ALL), B-cell acute lymphoid leukemia (B-ALL), T-cell acute lymphoid leukemia (T-ALL), chronic myelogenous leukemia (CML), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, or preleukemia.

The cancer can also be chosen from colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, combinations of said cancers, and metastatic lesions of said cancers.

In certain embodiments of the methods or uses described herein, the cell is administered in combination with an agent that increases the efficacy of the immune effector cell, e.g., one or more of a protein phosphatase inhibitor, a kinase inhibitor, a cytokine, an inhibitor of an immune inhibitory molecule; or an agent that decreases the level or activity of a TRE G cell.

In certain embodiments of the methods or uses described herein, the protein phosphatase inhibitor is a SHP-1 inhibitor and/or an SHP-2 inhibitor.

In other embodiments of the methods or uses described herein, kinase inhibitor is chosen from one or more of a CDK4 inhibitor, a CDK4/6 inhibitor (e.g., palbociclib), a BTK inhibitor (e.g., ibrutinib or RN-486), an mTOR inhibitor (e.g., rapamycin or everolimus (RAD001)), an MNK inhibitor, or a dual P13K/mTOR inhibitor. In one embodiment, the BTK inhibitor does not reduce or inhibit the kinase activity of interleukin-2-inducible kinase (ITK).

In other embodiments of the methods or uses described herein, the agent that decreases the level or activity of the $T_{REG}$ cells is chosen from cyclophosphamide, anti-GITR antibody, CD25-depletion, or a combination thereof.

In other embodiments, the agent that inhibits the inhibitory molecule comprises a first polypeptide comprising an inhibitory molecule or a fragment thereof and a second polypeptide that provides a positive signal to the cell, and wherein the first and second polypeptides are expressed on the CAR-containing immune cells, wherein (i) the first polypeptide comprises PD1, PD-L1, CTLA-4, TIM-3, LAG3, VISTA, BTLA, TIGIT, LAIR1, CD160, 2B4, TGF beta, CEACAM-1, CEACAM-3, and CEACAM-5 or a fragment thereof; and/or (ii) the second polypeptide comprises an intracellular signaling domain comprising a primary signaling domain and/or a costimulatory signaling domain. In one embodiment, the primary signaling domain comprises a functional domain of CD3 zeta; and/or the costimulatory signaling domain comprises a functional domain of a protein selected from 41BB, CD27 and CD28.

In other embodiments, cytokine is chosen from IL-7; IL-15; a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15; IL-18; IL-21, or a combination thereof. Exemplary hetIL-15 are heterodimeric non-covalent complexes of IL-15 and IL-15Ra (Admune Therapeutics, LLC). Such hetIL-15 is described in, e.g., U.S. Pat. No. 8,124,084, U.S. 2012/0177598, U.S. 2009/0082299, U.S. 2012/0141413, and U.S. 2011/0081311, incorporated herein by reference. hetIL-15 is described in, e.g., U.S. Pat. No. 8,124,084, U.S. 2012/0177598, U.S. 2009/0082299, U.S. 2012/0141413, and U.S. 2011/0081311, incorporated herein by reference. Other exemplary embodiments of hetIL-15 are covalent complexes between an IL-15 polypeptide and an IL-15R (e.g., IL-15Ra) polypeptide.

In other embodiments, the cell and a second, e.g., any of the combination therapies disclosed herein (e.g., the agent that that increases the efficacy of the cell) are administered substantially simultaneously or sequentially.

In other embodiments, the cell is administered in combination with a molecule that targets GITR and/or modulates GITR function. In certain embodiments, the molecule targeting GITR and/or modulating GITR function is administered prior to the CAR-expressing cell or population of cells, or prior to apheresis.

In one embodiment, lymphocyte infusion, for example allogeneic lymphocyte infusion, is used in the treatment of the cancer, wherein the lymphocyte infusion comprises at least one cell, e.g., CAR-expressing cell, of the present invention. In one embodiment, autologous lymphocyte infusion is used in the treatment of the cancer, wherein the autologous lymphocyte infusion comprises at least one cell, e.g., CAR-expressing cell described herein.

In one embodiment, the cell is a T cell and the T cell is diaglycerol kinase (DGK) deficient. In one embodiment, the cell is a T cell and the T cell is Ikaros deficient. In one embodiment, the cell is a T cell and the T cell is both DGK and Ikaros deficient.

In one embodiment, the method includes administering a cell of the invention, as described herein, in combination with an agent which enhances the activity of the cell, wherein the agent is a cytokine, e.g., IL-7; IL-15; a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15; IL-18; IL-21; or a combination thereof. The cytokine can be delivered in combination with, e.g., simultaneously or shortly after, administration of the cell. Alternatively, the cytokine can be delivered after a prolonged period of time after administration of the cell, e.g., after assessment of the subject's response to the cell. In one embodiment the cytokine is administered to the subject simultaneously (e.g., administered on the same day) with or shortly after administration (e.g., administered 1 day, 2 days, 3 days, 4 days, 5 days, 6 days, or 7 days after administration) of the cell or a population of cells. In other embodiments, the cytokine is administered to the subject after a prolonged period of time (e.g., e.g., at least 2 weeks, 3 weeks, 4 weeks, 6 weeks, 8 weeks, weeks, or more) after administration of the cell or a population of cells, or after assessment of the subject's response to the cell.

In other embodiments, the cells of the invention that are further engineered to express a CAR are administered in combination with an agent that ameliorates one or more side effects associated with administration of a cell expressing a CAR molecule. Side effects associated with the CAR-expressing cell can be chosen from cytokine release syndrome (CRS) or hemophagocytic lymphohistiocytosis (HLH).

In embodiments of any of the aforesaid methods or uses, the cells expressing the CAR molecule are administered in combination with an agent that treats the disease associated with expression of the tumor antigen, e.g., any of the second or third therapies disclosed herein. Additional exemplary combinations include one or more of the following.

In another embodiment, the cell, e.g., as described herein, can be administered in combination with another agent, e.g., a kinase inhibitor and/or checkpoint inhibitor described herein. In an embodiment, a cell of the invention can further express another agent, e.g., an agent which enhances the activity of the cell.

For example, in one embodiment, the agent that enhances the activity of the cell can be an agent which inhibits an inhibitory molecule.

In one embodiment, the agent that inhibits the inhibitory molecule is an inhibitory nucleic acid is a dsRNA, a siRNA, or a shRNA.

In another embodiment, the agent which inhibits an inhibitory molecule, e.g., is a molecule described herein, e.g., an agent that comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule, or a fragment thereof (e.g., at least a portion of the extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of the extracellular domain of PD1), and a second polypeptide of an intracellular signaling domain described herein (e.g., a CD28 signaling domain described herein and/or a CD3 zeta signaling domain described herein).

In one embodiment, the cell of the present invention, e.g., T cell or NK cell, is administered to a subject that has received a previous stem cell transplantation, e.g., autologous stem cell transplantation.

In one embodiment, the cell of the present invention, e.g., T cell or NK cells, is administered to a subject that has received a previous dose of melphalan.

In one embodiment, the cell of the invention, is administered in combination with an agent that increases the efficacy of the cell, e.g., an agent described herein.

In one embodiment, the cells of the invention, are administered in combination with a low, immune enhancing dose of an mTOR inhibitor. While not wishing to be bound by theory, it is believed that treatment with a low, immune enhancing, dose (e.g., a dose that is insufficient to completely suppress the immune system but sufficient to improve immune function) is accompanied by a decrease in PD-1 positive T cells or an increase in PD-1 negative cells. PD-1 positive T cells, but not PD-1 negative T cells, can be exhausted by engagement with cells which express a PD-1 ligand, e.g., PD-L1 or PD-L2. In an embodiment this approach can be used to optimize the performance of the cells described herein in the subject. While not wishing to be bound by theory, it is believed that, in an embodiment, the performance of endogenous, non-modified immune effector cells, e.g., T cells or NK cells, is improved. While not wishing to be bound by theory, it is believed that, in an embodiment, the performance of a CAR-expressing cell is improved. In other embodiments, cells, e.g., T cells or NK cells, which comprise or will be engineered to comprise a gRNA molecule of the invention, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

In an embodiment, administration of a low, immune enhancing, dose of an mTOR inhibitor, e.g., an allosteric inhibitor, e.g., RAD001, or a catalytic inhibitor, is initiated prior to administration of an CAR expressing cell described herein, e.g., T cells or NK cells. In an embodiment, the cells are administered after a sufficient time, or sufficient dosing, of an mTOR inhibitor, such that the level of PD1 negative immune effector cells, e.g., T cells or NK cells, or the ratio of PD1 negative immune effector cells, e.g., T cells/PD1 positive immune effector cells, e.g., T cells, has been, at least transiently, increased.

In an embodiment, the cell, e.g., T cell or NK cell, to be engineered to comprise a gRNA of the invention, is harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In one embodiment, the cell of the invention, is administered in combination with an agent that ameliorates one or more side effect associated with administration of a cell, e.g., an agent described herein.

In one embodiment, the cell is administered in combination with an agent that treats the disease associated with a cancer associated antigen as described herein, e.g., an agent described herein.

In one embodiment, the cell is administered at a dose and/or dosing schedule described herein.

In one embodiment, the subject (e.g., human) receives an initial administration of cells of the invention, and one or more subsequent administrations of cells of the invention, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of cells of the invention are administered to the subject (e.g., human) per week, e.g., 2, 3, or 4 administrations of cells comprising a CAR molecule are administered per week. In one embodiment, the subject (e.g., human subject) receives more than one administration of cells of the invention per week (e.g., 2, 3 or 4 administrations per week) (also referred to herein as a cycle), followed by a week of no administration of cells of the invention, and then one or more additional administration of cells of the invention (e.g., more than one administration of the cells of the invention per week) is administered to the subject. In another embodiment, the subject (e.g., human subject) receives more than one cycle of cells of the invention, and the time between each cycle is less than 10, 9, 8, 7, 6, 5, 4, or 3 days. In one embodiment, the cells of the invention are administered every other day for 3 administrations per week. In one embodiment, the cells of the invention are administered for at least two, three, four, five, six, seven, eight or more weeks.

In one embodiment, the cells of the invention, are administered as a first line treatment for the disease, e.g., the cancer, e.g., the cancer described herein. In another embodiment, the cells of the invention, are administered as a second, third, fourth line treatment for the disease, e.g., the cancer, e.g., the cancer described herein.

In one embodiment, a population of cells described herein is administered.

In another aspect, the invention pertains to the isolated nucleic acid molecule encoding a gRNA of the invention, the gRNA molecule of the invention, and the cell comprising or which at any time comprised a gRNA of the invention for use as a medicament. In embodiments, the cell comprising or which at any time comprised a gRNA of the invention is or will be altered such that expression of the functional product of the gene comprising sequence complimentary to the gRNA targeting domain is reduced or abolished.

In another aspect, the invention pertains to the isolated nucleic acid molecule encoding a gRNA of the invention, the gRNA molecule of the invention, and the cell comprising or which at any time comprised a gRNA of the invention for use in the treatment of a disease expressing a cancer associated antigen as described herein. In embodiments, the cell comprising or which at any time comprised a gRNA of the invention is or will be altered such that expression of the functional product of the gene comprising sequence complimentary to the gRNA targeting domain is reduced or abolished.

In another aspect, the invention pertains to the isolated nucleic acid molecule encoding a gRNA of the invention, the gRNA molecule of the invention, and the cell comprising or which at any time comprised a gRNA of the invention for use as a medicament in combination with a cytokine, e.g., IL-7; IL-15; a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15; IL-18; and/or IL-21; and/or combinations thereof as described herein. In another aspect, the invention pertains to a cytokine described herein for use as a medicament in combination with a cell described herein. In embodiments, the cell comprising or which at any time comprised a gRNA of the invention is or will be altered such that expression of the functional product of the gene comprising sequence complimentary to the gRNA targeting domain is reduced or abolished.

In another aspect, the invention pertains to the isolated nucleic acid molecule encoding a gRNA of the invention, the gRNA molecule of the invention, and the cell comprising or which at any time comprised a gRNA of the invention for use as a medicament in combination with a kinase inhibitor and/or a checkpoint inhibitor as described herein. In another aspect, the invention pertains to a kinase inhibitor and/or a checkpoint inhibitor described herein for use as a medicament in combination with a cell comprising or which at any time comprised a gRNA of the invention.

In another aspect, the invention features a composition comprising a cell of the invention for use in the treatment of a subject having a disease associated with expression of a tumor-supporting antigen, e.g., a disorder as described herein.

In any of the aforesaid methods or uses, the disease associated with expression of the tumor-supporting antigen is selected from the group consisting of a proliferative disease, a precancerous condition, a cancer, and a non-cancer related indication associated with expression of the tumor-supporting antigen. In an embodiment, the disease associated with a tumor-supporting antigen described herein is a solid tumor.

In one embodiment of the methods or uses described herein, the cell of the invention is administered in combination with another agent. In one embodiment, the agent can be a kinase inhibitor, e.g., a CDK4/6 inhibitor, a BTK inhibitor, an mTOR inhibitor, a MNK inhibitor, or a dual PI3K/mTOR inhibitor, and combinations thereof. In one embodiment, the kinase inhibitor is a CDK4 inhibitor, e.g., a CDK4 inhibitor described herein, e.g., a CD4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo[3,4-d]pyrimidine. The MNK inhibitor can be, e.g., a MNK1a, MNK1b, MNK2a and/or MNK2b inhibitor. The dual PI3K/mTOR inhibitor can be, e.g., PF-04695102.

In one embodiment of the methods or uses described herein, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]oxy]-N-[4-(trifluoromethyl)phenyl]-1H-benzimidazol-2-amine (RAF265); indisulam (E7070); roscovitine (CYC202); palbociclib (PD0332991); dinaciclib (SCH727965); N-[5-[[(5-tert-butyloxazol-2-yl)methyl]thio]thiazol-2-yl]piperidine-4-carboxamide (BMS 387032); 4-[[9-chloro-7-(2,6-difluorophenyl)-5H-pyrimido[5,4-d][2]benzazepin-2-yl]amino]-benzoic acid (MLN8054); 5-[3-(4,6-difluoro-1H-benzimidazol-2-yl)-1H-indazol-5-yl]-N-ethyl-4-methyl-3-pyridinemethanamine (AG-024322); 4-(2,6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4]-N-[4-(methylsulfonyl)phenyl]-2-pyrimidinamine (AZD5438); and XL281 (BMS908662).

In one embodiment of the methods or uses described herein, the kinase inhibitor is a CDK4 inhibitor, e.g., palbociclib (PD0332991), and the palbociclib is administered at a dose of about 50 mg, 60 mg, 70 mg, 75 mg, 80 mg, 90 mg, 100 mg, 105 mg, 110 mg, 115 mg, 120 mg, 125 mg, 130 mg, 135 mg (e.g., 75 mg, 100 mg or 125 mg) daily for a period of time, e.g., daily for 14-21 days of a 28 day cycle, or daily for 7-12 days of a 21 day cycle. In one embodiment, 1, 2, 3, 4, 5, 6, 7, 8, 9, 10, 11, 12 or more cycles of palbociclib are administered.

In one embodiment of the methods or uses described herein, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13. In one embodiment, the BTK inhibitor does not reduce or inhibit the kinase activity of interleukin-2-inducible kinase (ITK), and is selected from GDC-0834; RN-486; CGI-560; CGI-1764; HM-71224; CC-292; ONO-4059; CNX-774; and LFM-A13.

In one embodiment of the methods or uses described herein, the kinase inhibitor is a BTK inhibitor, e.g., ibrutinib (PCI-32765), and the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In one embodiment, 1, 2, 3, 4, 5, 6, 7, 8, 9, 10, 11, 12 or more cycles of ibrutinib are administered.

In one embodiment of the methods or uses described herein, the kinase inhibitor is a BTK inhibitor that does not inhibit the kinase activity of ITK, e.g., RN-486, and RN-486 is administered at a dose of about 100 mg, 110 mg, 120 mg, 130 mg, 140 mg, 150 mg, 160 mg, 170 mg, 180 mg, 190 mg, 200 mg, 210 mg, 220 mg, 230 mg, 240 mg, 250 mg (e.g., 150 mg, 200 mg or 250 mg) daily for a period of time, e.g., daily a 28 day cycle. In one embodiment, 1, 2, 3, 4, 5, 6, 7, or more cycles of RN-486 are administered.

In one embodiment of the methods or uses described herein, the kinase inhibitor is an mTOR inhibitor selected from temsirolimus; ridaforolimus (1R,2R,4S)-4-[(2R)-2 [(1R,9S,12S,15R,16E,18R,19R,21R, 23S,24E,26E,28Z, 30S,32S,35R)-1,18-dihydroxy-19,30-dimethoxy-15,17,21, 23,29,35-hexamethyl-2,3,10,14,20-pentaoxo-11,36-dioxa-4-azatricyclo[30.3.1.0$^{4,9}$]hexatriaconta-16,24,26,28-tetraen-12-yl]propyl]-2-methoxycyclohexyl dimethylphosphinate, also known as AP23573 and MK8669; everolimus (RAD001); rapamycin (AY22989); simapimod; (5-{2,4-bis[(3S)-3-methylmorpholin-4-yl]pyrido[2,3-d]pyrimidin-7-yl}-2-methoxyphenyl)methanol (AZD8055); 2-amino-8-[trans-4-(2-hydroxyethoxy)cyclohexyl]-6-(6-methoxy-3-pyridinyl)-4-methyl-pyrido[2,3-d]pyrimidin-7(8H)-one (PF04691502); and N$^2$-[1,4-dioxo-4-[[4-(4-oxo-8-phenyl-4H-1-benzopyran-2-yl)morpholinium-4-yl]methoxy]butyl]-arginylglycyl-L-α-aspartylL-serine—(SEQ ID NO: 6659), inner salt (SF1126); and XL765.

In one embodiment of the methods or uses described herein, the kinase inhibitor is an mTOR inhibitor, e.g., rapamycin, and the rapamycin is administered at a dose of about 3 mg, 4 mg, 5 mg, 6 mg, 7 mg, 8 mg, 9 mg, 10 mg (e.g., 6 mg) daily for a period of time, e.g., daily for 21 day cycle, or daily for 28 day cycle. In one embodiment, 1, 2, 3, 4, 5, 6, 7, 8, 9, 10, 11, 12 or more cycles of rapamycin are administered. In one embodiment, the kinase inhibitor is an mTOR inhibitor, e.g., everolimus and the everolimus is administered at a dose of about 2 mg, 2.5 mg, 3 mg, 4 mg, 5 mg, 6 mg, 7 mg, 8 mg, 9 mg, mg, 11 mg, 12 mg, 13 mg, 14 mg, 15 mg (e.g., 10 mg) daily for a period of time, e.g., daily for 28 day cycle. In one embodiment, 1, 2, 3, 4, 5, 6, 7, 8, 9, 10, 11, 12 or more cycles of everolimus are administered.

In one embodiment of the methods or uses described herein, the kinase inhibitor is an MNK inhibitor selected from CGP052088; 4-amino-3-(p-fluorophenylamino)-pyrazolo[3,4-d]pyrimidine (CGP57380); cercosporamide; ETC-1780445-2; and 4-amino-5-(4-fluoroanilino)-pyrazolo[3,4-d]pyrimidine.

In one embodiment of the methods or uses described herein, the kinase inhibitor is a dual phosphatidylinositol 3-kinase (PI3K) and mTOR inhibitor selected from 2-Amino-8-[trans-4-(2-hydroxyethoxy)cyclohexyl]-6-(6-methoxy-3-pyridinyl)-4-methyl-pyrido[2,3-d]pyrimidin-7 (8H)-one (PF-04691502); N-[4-[[4-(Dimethylamino)-1-piperidinyl]carbonyl]phenyl]-N'-[4-(4,6-di-4-morpholinyl-1,3,5-triazin-2-yl)phenyl]urea (PF-05212384, PKI-587); 2-Methyl-2-{4-[3-methyl-2-oxo-8-(quinolin-3-yl)-2,3-di-hydro-1H-imidazo[4,5-c]quinolin-1-yl]phenyl}propanenitrile (BEZ-235); apitolisib (GDC-0980, RG7422); 2,4-Difluoro-N-{2-(methyloxy)-5[4-(4-pyridazinyl)-6-quinolinyl]-3-pyridinyl}benzenesulfonamide (GSK2126458); 8-(6-methoxypyridin-3-yl)-3-methyl-1-(4-(piperazin-1-yl)-3-(trifluoromethyl)phenyl)-1H-imidazo[4,5-c]quinolin-2(3H)-one Maleic acid (NVP-BGT226); 3-[4-(4-Morpholinylpyrido[3',2':4,5]furo[3,2-d]pyrimidin-2-yl] phenol (PI-103); 5-(9-isopropyl-8-methyl-2-morpholino-9H-purin-6-yl)pyrimidin-2-amine (VS-5584, SB2343); and N-[2-[(3,5-Dimethoxyphenyl)amino]quinoxalin-3-yl]-4-[(4-methyl-3-methoxyphenyl)carbonyl]aminophenylsulfonamide (XL765).

In one embodiment of the methods or uses described herein, a CAR expressing immune effector cell described herein is administered to a subject in combination with a protein tyrosine phosphatase inhibitor, e.g., a protein tyrosine phosphatase inhibitor described herein. In one embodiment, the protein tyrosine phosphatase inhibitor is an SHP-1 inhibitor, e.g., an SHP-1 inhibitor described herein, such as, e.g., sodium stibogluconate. In one embodiment, the protein tyrosine phosphatase inhibitor is an SHP-2 inhibitor.

In one embodiment of the methods or uses described herein, the cell of the invention is administered in combination with another agent, and the agent is a cytokine. The cytokine can be, e.g., IL-7; IL-15; a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15; IL-18; IL-21; or a combination thereof. In another embodiment, the cell of the invention is administered in combination with a checkpoint inhibitor, e.g., a checkpoint inhibitor described herein. For example, in one embodiment, the check point inhibitor inhibits an inhibitory molecule selected from PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGF beta.

In one aspect, the invention provides a method of treating a subject, e.g., a subject having a condition described herein, with an allogeneic cell, for example an allogeneic immune effector cell, for example an allogeneic CAR-expressing T cell, comprising or which at any time comprised a gRNA molecule of the invention. In embodiments, the cell has been altered such that expression of the functional gene product of a gene comprising a target sequence complementary to the gRNA targeting domain has been reduced or eliminated.

In one aspect, the invention provides a method of treatment comprising:
(a) providing a population of cells from an allogeneic donor;
(b) introducing into the cells a CRISPR System (e.g., an *S. pyogenes* Cas9 CRISPR system) comprising a first gRNA molecule of the invention (or nucleic acid encoding said gRNA molecule);
(c) optionally, selecting those cells in which expression of the gene product (e.g., functional gene product) of the gene comprising the target sequence complementary to the targeting domain of the first gRNA has been reduced or eliminated;
(d) transducing the cells with nucleic acid encoding a CAR as described herein; and
(e) administering the cells to a patient in need thereof, e.g., a patient who has a disease associated with expression of an antigen recognized by the CAR.

In embodiments, the first gRNA molecule comprises a targeting domain complementary to an allogeneic T cell target, e.g., a component of the TCR, for example, a first gRNA molecule comprising a targeting domain complementary to a target sequence in a gene selected from CD247, CD3D, CD3E, CD3G, TRAC, TRBC1, and TRBC2. In embodiments, the first gRNA to CD247, CD3D, CD3E, CD3G, TRAC, TRBC1, or TRBC2 is a first gRNA comprising a targeting domain listed in Table 1, Table 4 or Table 5. In embodiments, step (c) comprises selected those cells which are negative for TCR expression. In embodiments, the method further comprises administering to the patient an agent which selectively inhibits or depletes NK cells, for example and antibody or antigen binding fragment to an antigen specific to NK cells, e.g., which is not expressed on T cells.

In embodiments, the method further comprises introducing into the cells a second gRNA molecule of the invention (or nucleic acid encoding said gRNA molecule), e.g., introducing into the cells a CRISPR System (e.g., an *S. pyogenes* Cas9 CRISPR system) comprising a second gRNA molecule of the invention (or nucleic acid encoding said gRNA molecule). In embodiments, the second gRNA molecule comprises a targeting domain complementary to an allogeneic T cell target, e.g., a second gRNA molecule comprising a targeting domain complementary to a target sequence in a gene selected from B2M, HLA-A, HLA-B and HLA-C. In embodiments, the second gRNA to B2M, HLA-A, HLA-B or HLA-C is a second gRNA comprising a targeting domain of Table 1, or Table 3. In embodiments, step (c) optionally includes, selecting those cells in which expression of the gene product (e.g., functional gene product) of the gene comprising the target sequence complementary to the targeting domain of the first gRNA and in which expression of the gene product (e.g., functional gene product) of the gene comprising the target sequence complementary to the targeting domain of the second gRNA has been reduced or eliminated. In embodiments, step (c) comprises selected those cells which are negative for TCR expression and/or negative for B2M or HLA expression. In embodiments, the method further comprises administering to the patient an agent which selectively inhibits or depletes NK cells, for example and antibody or antigen binding fragment to an antigen specific to NK cells, e.g., which is not expressed on T cells.

In embodiments, the method further comprises introducing into the cells a third gRNA molecule of the invention (or nucleic acid encoding said gRNA molecule), e.g., introducing into the cells a CRISPR System (e.g., an S. pyogenes Cas9 CRISPR system) comprising a second gRNA molecule of the invention (or nucleic acid encoding said gRNA molecule). In embodiments, the third gRNA molecule comprises a targeting domain complementary to a target sequence in a gene of an inhibitory molecule or downstream effector of signaling through an inhibitory molecule, e.g., a third gRNA molecule comprising a targeting domain complementary to a target sequence in a gene selected from CD274, HAVCR2, LAG3, PDCD1, PD-L2, CTLA4, CEACAM (e.g., CEACAM-1, CEACAM-3 and/or CEACAM-5), VISTA, BTLA, TIGIT, LAIR1, CD160, 2B4, CD80, CD86, B7-H3 (CD113), B7-H4 (VTCN1), HVEM (TNFRSF14 or CD107), KIR, A2aR, MHC class I, MHC class II, GAL9, adenosine, and TGF beta, and PTPN11. In embodiments, the third gRNA comprises a targeting domain to CD274, HAVCR2, LAG3, PDCD1 or PTPN11 selected from the targeting domains of Table 2, or Table 6. In embodiments, step (c) optionally includes, selecting those cells in which expression of the gene product (e.g., functional gene product) of the gene comprising the target sequence complementary to the targeting domain of the first gRNA, in which expression of the gene product (e.g., functional gene product) of the gene comprising the target sequence complementary to the targeting domain of the second gRNA, and/or in which expression of the gene product (e.g., functional gene product) of the gene comprising the target sequence complementary to the targeting domain of the third gRNA has been reduced or eliminated. In embodiments, step (c) comprises selecting those cells which are negative for TCR expression, negative for B2M or HLA expression, and/or negative for expression of a targeted inhibitory molecule or downstream effector of signaling through an inhibitory molecule. In embodiments, the method further comprises administering to the patient an agent which selectively inhibits or depletes NK cells, for example and antibody or antigen binding fragment to an antigen specific to NK cells, e.g., which is not expressed on T cells. In other embodiments, the third gRNA comprises a targeting domain complementary to a target sequence in a gene selected from CIITA, RFXANK, RFX5, RFXAP, e.g., as described herein. In embodiments, the third gRNA comprises a targeting domain complementary to a target sequence in a CIITA gene, e.g., as described herein, e.g., in Table 6c.

In any of the aforementioned aspects and embodiments the CAR is a CAR as described herein. In any of the aforementioned aspects and embodiments, the CAR is a BCMA CAR, e.g., a BCMA CAR described herein, e.g., comprises or is engineered to express a CAR comprising SEQ ID NO:8559. In aspects, the nucleic acid encoding the CAR is introduced into the cell by viral vector, e.g., lentiviral vector, transduction. In other aspects, the nucleic acid encoding the CAR is introduced as DNA that is incorporated in the host cell genome at or near a site modified by one of the CRISPR systems introduced into said cells.

In one aspect, the invention provides a method of treatment comprising:
(a) providing a population of cells, e.g, immune effector cells, e.g., T cell or NK cells, e.g., as described herein, (e.g., a population of said cells from an allogeneic donor);
(b) introducing into the population of cells a CRISPR System (e.g., an S. pyogenes Cas9 CRISPR system) comprising a first gRNA molecule of the invention (or nucleic acid encoding said gRNA molecule) comprising a targeting domain complementary to a target sequence in CD247, CD3D, CD3E, CD3G, TRAC, TRBC1, TRBC2, e.g., a target sequence in TRAC, TRBC1 or TRBC2, e.g., a target sequence in TRAC, e.g., as described herein;
(c) introducing into the population of cells a CRISPR System (e.g., an S. pyogenes Cas9 CRISPR system) comprising a second gRNA molecule of the invention (or nucleic acid encoding said gRNA molecule) comprising a targeting domain complementary to a target sequence in B2M, e.g., as described herein;
(d) optionally, selecting those cells in which expression of functional TCR has been reduced or eliminated;
(e) transducing the population of cells with nucleic acid encoding a CAR, e.g., as described herein, e.g., a BCMA CAR as described herein; and
(f) administering the population of cells to a patient in need thereof, e.g., a patient who has a disease associated with expression of an antigen recognized by the CAR.

In one embodiment, the method further comprises the step of (g) introducing into said population of cells into the population of cells a CRISPR System (e.g., an S. pyogenes Cas9 CRISPR system) comprising a third gRNA molecule of the invention (or nucleic acid encoding said gRNA molecule) comprising a targeting domain complementary to a target sequence in CIITA, RFXANK, RFX5 or RFXAP, e.g., complementary to a target sequence in CIITA, e.g., as described herein.

In one aspect, the invention provides a method of treatment comprising:
(a) providing a population of cells, e.g, immune effector cells, e.g., T cell or NK cells, e.g., as described herein, (e.g., a population of said cells from an allogeneic donor);
(b) introducing into the population of cells a CRISPR System (e.g., an S. pyogenes Cas9 CRISPR system) comprising a first gRNA molecule of the invention (or nucleic acid encoding said gRNA molecule) comprising a targeting domain complementary to a target sequence in CD247, CD3D, CD3E, CD3G, TRAC, TRBC1, TRBC2, e.g., a target sequence in TRAC, TRBC1 or TRBC2, e.g., a target sequence in TRAC, e.g., as described herein;

(c) introducing into the population of cells a CRISPR System (e.g., an *S. pyogenes* Cas9 CRISPR system) comprising a second gRNA molecule of the invention (or nucleic acid encoding said gRNA molecule) comprising a targeting domain complementary to a target sequence in NLRC5, e.g., as described herein;

(d) optionally, selecting those cells in which expression of functional TCR has been reduced or eliminated;

(e) transducing the population of cells with nucleic acid encoding a CAR, e.g., as described herein, e.g., a BCMA CAR as described herein; and (f) administering the population of cells to a patient in need thereof, e.g., a patient who has a disease associated with expression of an antigen recognized by the CAR.

In one embodiment, the method further comprises the step of (g) introducing into said population of cells into the population of cells a CRISPR System (e.g., an *S. pyogenes* Cas9 CRISPR system) comprising a third gRNA molecule of the invention (or nucleic acid encoding said gRNA molecule) comprising a targeting domain complementary to a target sequence in CIITA, RFXANK, RFX5 or RFXAP, e.g., complementary to a target sequence in CIITA, e.g., as described herein.

In one aspect, the invention provides a method of treatment comprising:

(a) providing a population of cells, for example immune effector cells (e.g., NK or T cells), from an allogeneic or autologous donor;

(b) introducing into the cells a CRISPR System (e.g., an *S. pyogenes* Cas9 CRISPR system) comprising a first gRNA molecule of the invention (or nucleic acid encoding said gRNA molecule);

(c) optionally, selecting those cells in which expression of the gene product (e.g., functional gene product) of the gene comprising the target sequence complementary to the targeting domain of the first gRNA has been reduced or eliminated;

(d) transducing the cells with nucleic acid encoding a CAR as described herein; and (e) administering the cells to a patient in need thereof, e.g., a patient who has a disease associated with expression of an antigen recognized by the CAR.

In embodiments, the first gRNA molecule comprises a targeting domain complementary to a target sequence in a gene of an inhibitory molecule or downstream effector of signaling through an inhibitory molecule, e.g., a first gRNA molecule comprising a targeting domain complementary to a target sequence in a gene selected from CD274, HAVCR2, LAG3, PDCD1, PD-L2, CTLA4, CEACAM (e.g., CEACAM-1, CEACAM-3 and/or CEACAM-5), VISTA, BTLA, TIGIT, LAIR1, CD160, 2B4, CD80, CD86, B7-H3 (CD113), B7-H4 (VTCN1), HVEM (TNFRSF14 or CD107), KIR, A2aR, MHC class I, MHC class II, GAL9, adenosine, and TGF beta, and PTPN11. In embodiments, the first gRNA comprises a targeting domain to CD274, HAVCR2, LAG3, PDCD1 or PTPN11 selected from the targeting domains of Table 2 or Table 6. In embodiments, step (c) optionally includes selecting those cells in which expression of the gene product (e.g., functional gene product) of the gene comprising the target sequence complementary to the targeting domain of the first gRNA has been reduced or eliminated.

In embodiments, the method further comprises introducing into the cells at least a second gRNA molecule (e.g., 2 or more gRNA molecules) of the invention (or nucleic acid encoding said gRNA molecule(s)). In embodiments, each additional gRNA molecule(s), e.g., the second gRNA molecule, comprises a targeting domain complementary to a target sequence in a gene of an inhibitory molecule or downstream effector of signaling through an inhibitory molecule, e.g., to a target sequence in a gene selected from CD274, HAVCR2, LAG3, PDCD1, PD-L2, CTLA4, CEACAM (e.g., CEACAM-1, CEACAM-3 and/or CEACAM-5), VISTA, BTLA, TIGIT, LAIR1, CD160, 2B4, CD80, CD86, B7-H3 (CD113), B7-H4 (VTCN1), HVEM (TNFRSF14 or CD107), KIR, A2aR, MHC class I, MHC class II, GAL9, adenosine, and TGF beta, and PTPN11. In embodiments, the third gRNA comprises a targeting domain to CD274, HAVCR2, LAG3, PDCD1 or PTPN11 selected from the targeting domains of Table 2 or Table 6. In embodiments, each additional gRNA molecule comprises a targeting domain complementary to a sequence in the gene of a different inhibitory molecule or downstream effector of signaling through an inhibitory molecule In embodiments, step (c) optionally includes, selecting those cells in which expression of the gene product (e.g., functional gene product) of the gene comprising the target sequence complementary to the targeting domain of the first gRNA, in which expression of the gene product (e.g., functional gene product) of the gene comprising the target sequence complementary to the targeting domain of the second gRNA, and/or in which expression of the gene product (e.g., functional gene product) of the gene comprising the target sequence complementary to the targeting domain of the third or more gRNA (if present) has been reduced or eliminated.

In one aspect, the invention provides a method of treating a subject, e.g., a subject having a condition described herein, with an allogeneic cell, for example an allogeneic immune effector cell, for example an allogeneic CAR-expressing T cell, comprising or which at any time comprised a gRNA molecule targeting a component of the TCR and a gRNA molecule targeting a target of an immunosuppressant. In embodiments, the cell has been altered such that expression of a functional TCR and expression of a functional target of an immunosuppressant has been reduced or eliminated.

In one aspect, the invention provides a method of treatment comprising:

(a) providing a population of cells from an allogeneic donor;

(b) introducing into the cells a CRISPR System (e.g., an *S. pyogenes* Cas9 CRISPR system) comprising a first gRNA molecule of the invention (or nucleic acid encoding said gRNA molecule) comprising a targeting domain complementary to a target sequence in CD247, CD3D, CD3E, CD3G, TRAC, TRBC1, TRBC2;

(c) introducing into the cells a CRISPR System (e.g., an *S. pyogenes* Cas9 CRISPR system) comprising a second gRNA molecule of the invention (or nucleic acid encoding said gRNA molecule) comprising a targeting domain complementary to a target sequence in DCK, CD52, FKBP1A or NR3C1;

(d) optionally, selecting those cells in which expression of functional TCR, expression of functional target of an immunosuppressant, or expression of functional TCR and functional target of an immunosuppressant has been reduced or eliminated;

(e) transducing the cells with nucleic acid encoding a CAR as described herein; and (f) administering the cells to a patient in need thereof, e.g., a patient who has a disease associated with expression of an antigen recognized by the CAR; and (g) administering to the patient an immunosuppressant that binds to the target of an immunosuppressant targeted by the gRNA of (c).

In embodiments, the first gRNA to CD247, CD3D, CD3E, CD3G, TRAC, TRBC1, or TRBC2 is a first gRNA comprising a targeting domain listed in Table 1, Table 4 or Table 5. In embodiments, the second gRNA to DCK, CD52, FKBP1A or NR3C1 is a second gRNA molecule comprising a targeting domain listed in Table 1. In embodiments, the first gRNA targets TRAC, TRBC1 or TRBC2. In embodiments, the second gRNA targets DCK, and the immunosuppressant of (g) is a nucleoside analog-based drug such as cytarabine (cytosine arabinoside) or gemcitabine. In an embodiment, the second gRNA targets NR3C1 (the gene encoding for glucocorticoid receptor (GR)), and the immunosuppressant is a corticosteroid such as dexamethasone. In an embodiment, the second gRNA targets CD52, and the immunosuppressant is an anti-CD52 antibody or antigen-binding fragment thereof such as alemtuzumab (CAMPATH®). In an embodiment, the second gRNA targets FKBP1A, and the immunosuppressant is FK506 (or FKBP12-binding fragment or analog thereof), cyclosporine, rapamycin or rapalog, or mTor inhibitor such as RAD001.

In any of the embodiments and aspects of the invention, including in any of the aforementioned aspects and embodiments, the population of cells may be enriched, for example, during manufacturing, for a particular subset or subpopulation, e.g., for T-cells, e.g., for stem-cell memory-like T cells.

In another aspect, a method of treating a subject, e.g., reducing or ameliorating, a hyperproliferative condition or disorder (e.g., a cancer), e.g., solid tumor, a soft tissue tumor, or a metastatic lesion, in a subject is provided. As used herein, the term "cancer" is meant to include all types of cancerous growths or oncogenic processes, metastatic tissues or malignantly transformed cells, tissues, or organs, irrespective of histopathologic type or stage of invasiveness. Examples of solid tumors include malignancies, e.g., sarcomas, adenocarcinomas, and carcinomas, of the various organ systems, such as those affecting liver, lung, breast, lymphoid, gastrointestinal (e.g., colon), genitourinary tract (e.g., renal, urothelial cells), prostate and pharynx. Adenocarcinomas include malignancies such as most colon cancers, rectal cancer, renal-cell carcinoma, liver cancer, non-small cell carcinoma of the lung, cancer of the small intestine and cancer of the esophagus. In one embodiment, the cancer is a melanoma, e.g., an advanced stage melanoma. Metastatic lesions of the aforementioned cancers can also be treated or prevented using the methods and compositions of the invention. Examples of other cancers that can be treated include bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin Disease, non-Hodgkin lymphoma, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, chronic or acute leukemias including acute myeloid leukemia, chronic myeloid leukemia, acute lymphoblastic leukemia, chronic lymphocytic leukemia, solid tumors of childhood, lymphocytic lymphoma, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers including those induced by asbestos, and combinations of said cancers. Treatment of metastatic cancers, e.g., metastatic cancers that express PD-L1 (Iwai et al. (2005) Int. Immunol. 17:133-144) can be effected using the antibody molecules described herein.

Exemplary cancers whose growth can be inhibited include cancers typically responsive to immunotherapy. Non-limiting examples of cancers for treatment include melanoma (e.g., metastatic malignant melanoma), renal cancer (e.g. clear cell carcinoma), prostate cancer (e.g. hormone refractory prostate adenocarcinoma), breast cancer, colon cancer and lung cancer (e.g. non-small cell lung cancer). Additionally, refractory or recurrent malignancies can be treated using the molecules described herein.

In one aspect, the invention pertains to a method of treating cancer in a subject. In one aspect, the cancer associated with expression of a cancer associate antigen as described herein is a hematological cancer. In one aspect, the hematological cancer is a leukemia or a lymphoma. In one aspect, a cancer associated with expression of a cancer associate antigen as described herein includes cancers and malignancies including, but not limited to, e.g., one or more acute leukemias including but not limited to, e.g., B-cell acute Lymphoid Leukemia ("BALL"), T-cell acute Lymphoid Leukemia ("TALL"), acute lymphoid leukemia (ALL); one or more chronic leukemias including but not limited to, e.g., chronic myelogenous leukemia (CML), Chronic Lymphoid Leukemia (CLL). Additional cancers or hematologic conditions associated with expression of a cancer associate antigen as described herein include, but are not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like. Further a disease associated with a cancer associate antigen as described herein expression include, but not limited to, e.g., atypical and/or non-classical cancers, malignancies, precancerous conditions or proliferative diseases associated with expression of a cancer associate antigen as described herein.

In some embodiments, a cancer that can be treated is multiple myeloma. Generally, myeloma cells are thought to be negative for a cancer associate antigen as described herein expression by flow cytometry.

Thus, in some embodiments, a cell further engineered to express a CAR as described herein, e.g., a CD19 CAR or BCMA CAR as described herein, may be used to target myeloma cells. In some embodiments, cars of the present invention therapy can be used in combination with one or more additional therapies, e.g., lenalidomide treatment.

In various aspects, the immune effector cells (e.g., T cells, NK cells) of the invention administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the T cell or NK cell to the patient.

The invention also includes a type of cellular therapy where immune effector cells (e.g., T cells, NK cells) are further modified, e.g., by in vitro transcribed RNA, to transiently express a chimeric antigen receptor (CAR) and the CAR T cell or NK cell is infused to a recipient in need thereof. The infused cell is able to kill tumor cells in the recipient. Thus, in various aspects, the immune effector cells (e.g., T cells, NK cells) administered to the patient, is present for less than one month, e.g., three weeks, two weeks, one week, after administration of the T cell or NK cell to the patient.

Without wishing to be bound by any particular theory, the anti-tumor immunity response elicited by the CAR-modified immune effector cells (e.g., T cells, NK cells) may be an active or a passive immune response, or alternatively may be due to a direct vs indirect immune response. In one aspect, the CAR transduced immune effector cells (e.g., T cells, NK cells) exhibit specific proinflammatory cytokine secretion and potent cytolytic activity in response to human cancer cells expressing the a cancer associate antigen as described herein, resist soluble a cancer associate antigen as described herein inhibition, mediate bystander killing and mediate regression of an established human tumor. For example, antigen-less tumor cells within a heterogeneous field of a cancer associate antigen as described herein-expressing tumor may be susceptible to indirect destruction by a cancer associate antigen as described herein-redirected immune effector cells (e.g., T cells, NK cells) that has previously reacted against adjacent antigen-positive cancer cells.

Ex vivo procedures are well known in the art and are discussed more fully below. Briefly, cells are isolated from a mammal (e.g., a human) and genetically modified (i.e., transduced or transfected in vitro) with a gRNA molecule of the invention, and optionally, a vector expressing a CAR disclosed herein. The modified cell can be administered to a mammalian recipient to provide a therapeutic benefit. The mammalian recipient may be a human and the cell can be autologous with respect to the recipient. Alternatively, the cells can be allogeneic with respect to the recipient.

The procedure for ex vivo expansion of hematopoietic stem and progenitor cells is described in U.S. Pat. No. 5,199,942, incorporated herein by reference, can be applied to the cells of the present invention. Other suitable methods are known in the art, therefore the present invention is not limited to any particular method of ex vivo expansion of the cells. Briefly, ex vivo culture and expansion of immune effector cells (e.g., T cells, NK cells) comprises: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

Procedures for ex vivo expansion of immune effector cells, e.g., T cells, are described, for example, in WO2015/142675, the contents of which are hereby incorporated by reference in their entirety. Such procedures may be useful when used in conjunction with the methods described herein.

In addition to using a cell-based vaccine in terms of ex vivo immunization, the present invention also provides compositions and methods for in vivo immunization to elicit an immune response directed against an antigen in a patient.

Generally, the cells activated and expanded as described herein may be utilized in the treatment and prevention of diseases that arise in individuals who are immunocompromised. In particular, the CAR-modified immune effector cells (e.g., T cells, NK cells) of the invention are used in the treatment of diseases, disorders and conditions associated with expression of a cancer associate antigen as described herein. In certain aspects, the cells of the invention are used in the treatment of patients at risk for developing diseases, disorders and conditions associated with expression of a cancer associate antigen as described herein. Thus, the present invention provides methods for the treatment or prevention of diseases, disorders and conditions associated with expression of a cancer associate antigen as described herein comprising administering to a subject in need thereof, a therapeutically effective amount of the CAR-modified immune effector cells (e.g., T cells, NK cells) of the invention.

In one aspect the cells of the invention, including the cells further engineered to express a CAR, may be used to treat a proliferative disease such as a cancer or malignancy or is a precancerous condition such as a myelodysplasia, a myelodysplastic syndrome or a preleukemia. Further a disease associated with a cancer associate antigen as described herein expression include, but not limited to, e.g., atypical and/or non-classical cancers, malignancies, precancerous conditions or proliferative diseases expressing a cancer associated antigen as described herein. Non-cancer related indications associated with expression of a cancer associate antigen as described herein include, but are not limited to, e.g., autoimmune disease, (e.g., lupus), inflammatory disorders (allergy and asthma) and transplantation.

The cells (e.g., T cells, NK cells) of the present invention may be administered either alone, or as a pharmaceutical composition in combination with diluents and/or with other components such as IL-2 or other cytokines or cell populations.

Hematologic Cancer

Hematological cancer conditions are the types of cancer such as leukemia, lymphoma, and malignant lymphoproliferative conditions that affect blood, bone marrow and the lymphatic system.

Leukemia can be classified as acute leukemia and chronic leukemia. Acute leukemia can be further classified as acute myelogenous leukemia (AML) and acute lymphoid leukemia (ALL). Chronic leukemia includes chronic myelogenous leukemia (CML) and chronic lymphoid leukemia (CLL). Other related conditions include myelodysplastic syndromes (MDS, formerly known as "preleukemia") which are a diverse collection of hematological conditions united by ineffective production (or dysplasia) of myeloid blood cells and risk of transformation to AML.

Lymphoma is a group of blood cell tumors that develop from lymphocytes. Exemplary lymphomas include non-Hodgkin lymphoma and Hodgkin lymphoma.

The present invention also provides methods for inhibiting the proliferation or reducing a cancer associated antigen as described herein-expressing cell population, the methods comprising contacting a population of cells comprising a cancer associated antigen as described herein-expressing cell with a cell of the invention (e.g., an NK cell or T cell) further engineered to express a CAR that binds to the a cancer associated antigen as described herein-expressing cell. In a specific aspect, the present invention provides methods for inhibiting the proliferation or reducing the population of cancer cells expressing a cancer associated antigen as described herein, the methods comprising contacting a cancer associate antigen as described herein-expressing cancer cell population with a T cell or NK cell of the invention further engineered to express a CAR that binds to a cancer associated antigen as described herein-expressing cell. In one aspect, the present invention provides methods for inhibiting the proliferation or reducing the population of cancer cells expressing a cancer associated antigen as described herein, the methods comprising contacting a cancer associated antigen as described herein-expressing cancer cell population with a T cell or NK cell of the invention further engineered to express a CAR that binds to a cancer associated antigen as described herein-expressing cell. In certain aspects, T cell or NK cell of the invention reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for myeloid leukemia or another cancer associated with a cancer associated antigen as described herein-expressing cells relative to a negative control. In one aspect, the subject is a human.

The present invention also provides methods for preventing, treating and/or managing a disease associated with a cancer associated antigen as described herein-expressing cells (e.g., a hematologic cancer or atypical cancer expressing a cancer associated antigen as described herein), the methods comprising administering to a subject in need a T cell or NK cell of the invention, including those further engineered to express a CAR that binds to a cancer associated antigen as described herein-expressing cell. In one aspect, the subject is a human. Non-limiting examples of disorders associated with a cancer associated antigen as described herein-expressing cells include autoimmune disorders (such as lupus), inflammatory disorders (such as allergies and asthma) and cancers (such as hematological cancers or atypical cancers expressing a cancer associated antigen as described herein).

The present invention also provides methods for preventing, treating and/or managing a disease associated with a cancer associated antigen as described herein-expressing cells, the methods comprising administering to a subject in need a T cell or NK cell of the invention, including those further engineered to express a CAR that binds to a cancer associated antigen as described herein-expressing cell. In one aspect, the subject is a human.

The present invention provides methods for preventing relapse of cancer associated with a cancer associated antigen as described herein-expressing cells, the methods comprising administering to a subject in need thereof a T cell or NK cell of the invention, including those further engineered to express a CAR that binds to a cancer associated antigen as described herein-expressing cell. In one aspect, the methods comprise administering cell in combination with an effective amount of another therapy.

Pharmaceutical Compositions and Treatments

Pharmaceutical compositions of the present invention may comprise a cell, e.g., a plurality of cells, as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are in one aspect formulated for intravenous administration.

Pharmaceutical compositions of the present invention may be administered in a manner appropriate to the disease to be treated (or prevented). The quantity and frequency of administration will be determined by such factors as the condition of the patient, and the type and severity of the patient's disease, although appropriate dosages may be determined by clinical trials.

In one embodiment, the pharmaceutical composition is substantially free of, e.g., there are no detectable levels of a contaminant, e.g., selected from the group consisting of endotoxin, *mycoplasma*, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis, Candida albicans, Escherichia coli, Haemophilus influenza, Neisseria meningitides, Pseudomonas aeruginosa, Staphylococcus aureus, Streptococcus pneumonia*, and *Streptococcus pyogenes* group A.

When "an immunologically effective amount," "an anti-tumor effective amount," "a tumor-inhibiting effective amount," or "therapeutic amount" is indicated, the precise amount of the compositions of the present invention to be administered can be determined by a physician with consideration of individual differences in age, weight, tumor size, extent of infection or metastasis, and condition of the patient (subject). It can generally be stated that a pharmaceutical composition comprising the immune effector cells (e.g., T cells, NK cells) described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988).

In certain aspects, it may be desired to administer activated immune effector cells (e.g., T cells, NK cells) to a subject and then subsequently redraw blood (or have an apheresis performed), activate immune effector cells (e.g., T cells, NK cells) therefrom according to the present invention, and reinfuse the patient with these activated and expanded immune effector cells (e.g., T cells, NK cells). This process can be carried out multiple times every few weeks. In certain aspects, immune effector cells (e.g., T cells, NK cells) can be activated from blood draws of from 10 cc to 400 cc. In certain aspects, immune effector cells (e.g., T cells, NK cells) are activated from blood draws of 20 cc, 30 cc, 40 cc, 50 cc, 60 cc, 70 cc, 80 cc, 90 cc, or 100 cc.

The administration of the subject compositions may be carried out in any convenient manner, including by aerosol inhalation, injection, ingestion, transfusion, implantation or transplantation. The compositions described herein may be administered to a patient trans arterially, subcutaneously, intradermally, intratumorally, intranodally, intramedullary, intramuscularly, by intravenous (i.v.) injection, or intraperitoneally. In one aspect, the T cell compositions of the present invention are administered to a patient by intradermal or subcutaneous injection. In one aspect, the T cell compositions of the present invention are administered by i.v. injection. The compositions of immune effector cells (e.g., T cells, NK cells) may be injected directly into a tumor, lymph node, or site of infection.

In a particular exemplary aspect, subjects may undergo leukapheresis, wherein leukocytes are collected, enriched, or depleted ex vivo to select and/or isolate the cells of interest, e.g., T cells. These T cell isolates may be expanded by methods known in the art and treated as described herein thereby creating a T cell of the invention. Subjects in need thereof may subsequently undergo standard treatment with high dose chemotherapy followed by peripheral blood stem cell transplantation. In certain aspects, following or concurrent with the transplant, subjects receive an infusion of the expanded T cells of the present invention. In an additional aspect, expanded cells are administered before or following surgery.

The dosage of the above treatments to be administered to a patient will vary with the precise nature of the condition being treated and the recipient of the treatment. The scaling of dosages for human administration can be performed according to art-accepted practices. The dose for CAMPATH, for example, will generally be in the range 1 to about 100 mg for an adult patient, usually administered daily for a period between 1 and 30 days. The preferred daily dose is 1 to 10 mg per day although in some instances larger doses of up to 40 mg per day may be used (described in U.S. Pat. No. 6,120,766).

In one aspect, CAR-expressing cells of the present inventions are generated using lentiviral viral vectors, such as lentivirus. Cells, e.g., CARTs, generated that way will have stable CAR expression.

In one aspect, CAR-expressing cells, e.g., CARTs, are generated using a viral vector such as a gammaretroviral vector, e.g., a gammaretroviral vector described herein. CARTs generated using these vectors can have stable CAR expression.

In one aspect, CARTs transiently express CAR vectors for 4, 5, 6, 7, 8, 9, 10, 11, 12, 13, 14, 15 days after transduction. Transient expression of CARs can be effected by RNA CAR vector delivery. In one aspect, the CAR RNA is transduced into the T cell by electroporation.

A potential issue that can arise in patients being treated using transiently expressing CAR immune effector cells (e.g., T cells, NK cells) (particularly with murine scFv bearing CARTs) is anaphylaxis after multiple treatments.

Without being bound by this theory, it is believed that such an anaphylactic response might be caused by a patient developing humoral anti-CAR response, i.e., anti-CAR antibodies having an anti-IgE isotype. It is thought that a patient's antibody producing cells undergo a class switch from IgG isotype (that does not cause anaphylaxis) to IgE isotype when there is a ten to fourteen day break in exposure to antigen.

If a patient is at high risk of generating an anti-CAR antibody response during the course of transient CAR therapy (such as those generated by RNA transductions), CART infusion breaks should not last more than ten to fourteen days.

Methods of Making Modified CAR-Expressing Cells

In another aspect, the invention pertains to a method of making a cell (e.g., an immune effector cell or population thereof) comprising introducing into (e.g., transducing) a cell, e.g., a T cell or a NK cell described herein, with a vector of comprising a nucleic acid encoding a CAR, e.g., a CAR described herein; or a nucleic acid encoding a CAR molecule e.g., a CAR described herein.

The cell in the methods is an immune effector cell (e.g., a T cell or a NK cell, or a combination thereof). In some embodiments, the cell in the methods is diaglycerol kinase (DGK) and/or Ikaros deficient.

In some embodiments, the introducing the nucleic acid molecule encoding a CAR comprises transducing a vector comprising the nucleic acid molecule encoding a CAR, or transfecting the nucleic acid molecule encoding a CAR, wherein the nucleic acid molecule is an in vitro transcribed RNA.

In some embodiments, the method further comprises:
providing a population of immune effector cells (e.g., T cells or NK cells); and
removing T regulatory cells from the population, thereby providing a population of T regulatory-depleted cells;
wherein steps a) and b) are performed prior to introducing the nucleic acid encoding the CAR and/or CRISPR system to the population.

In embodiments of the methods, the T regulatory cells comprise CD25+ T cells, and are removed from the cell population using an anti-CD25 antibody, or fragment thereof. The anti-CD25 antibody, or fragment thereof, can be conjugated to a substrate, e.g., a bead.

In other embodiments, the population of T regulatory-depleted cells provided from step (b) contains less than 30%, 25%, 20%, 15%, 10%, 5%, 4%, 3%, 2%, 1% of CD25+ cells.

In yet other embodiments, the method further comprises removing cells from the population which express a tumor antigen that does not comprise CD25 to provide a population of T regulatory-depleted and tumor antigen depleted cells prior to introducing the nucleic acid encoding a CAR to the population. The tumor antigen can be selected from CD19, CD30, CD38, CD123, CD20, CD14 or CD11b, or a combination thereof.

In other embodiments, the method further comprises removing cells from the population which express a checkpoint inhibitor, to provide a population of T regulatory-depleted and inhibitory molecule depleted cells prior to introducing the nucleic acid encoding a CAR or CRISPR system to the population. The checkpoint inhibitor can be chosen from PD-1, LAG-3, TIM3, B7-H1, CD160, P1H, 2B4, CEACAM (e.g., CEACAM-1, CEACAM-3, and/or CEACAM-5), TIGIT, CTLA-4, BTLA, and LAIR1.

Further embodiments disclosed herein encompass providing a population of immune effector cells. The population of immune effector cells provided can be selected based upon the expression of one or more of CD3, CD28, CD4, CD8, CD45RA, and/or CD45RO. In certain embodiments, the population of immune effector cells provided are CD3+ and/or CD28+.

In certain embodiments of the method, the method further comprises expanding the population of cells after the nucleic acid molecule encoding a CAR has been introduced.

In embodiments, the population of cells is expanded for a period of 8 days or less.

In certain embodiments, the population of cells is expanded in culture for 5 days, and the resulting cells are more potent than the same cells expanded in culture for 9 days under the same culture conditions.

In other embodiments, the population of cells is expanded in culture for 5 days show at least a one, two, three or four fold increase in cell doublings upon antigen stimulation as compared to the same cells expanded in culture for 9 days under the same culture conditions.

In yet other embodiments, the population of cells is expanded in culture for 5 days, and the resulting cells exhibit higher proinflammatory IFN-γ and/or GM-CSF levels, as compared to the same cells expanded in culture for 9 days under the same culture conditions.

In other embodiments, the population of cells is expanded by culturing the cells in the presence of an agent that stimulates a CD3/TCR complex associated signal and/or a ligand that stimulates a costimulatory molecule on the surface of the cells. The agent can be a bead conjugated with anti-CD3 antibody, or a fragment thereof, and/or anti-CD28 antibody, or a fragment thereof.

In other embodiments, the population of cells is expanded in an appropriate media that includes one or more interleukin that result in at least a 200-fold, 250-fold, 300-fold, or 350-fold increase in cells over a 14 day expansion period, as measured by flow cytometry.

In other embodiments, the population of cells is expanded in the presence IL-15 and/or IL-7.

In certain embodiments, the method further includes cryopreserving the population of the cells after the appropriate expansion period.

In yet other embodiments, the method of making disclosed herein further comprises contacting the population of immune effector cells with a nucleic acid encoding a telomerase subunit, e.g., hTERT. The the nucleic acid encoding the telomerase subunit can be DNA.

The present invention also provides a method of generating a population of RNA-engineered cells, e.g., cells described herein, e.g., immune effector cells (e.g., T cells, NK cells), transiently expressing exogenous RNA. The method comprises introducing an in vitro transcribed RNA or synthetic RNA into a cell, where the RNA comprises a nucleic acid encoding a CAR molecule described herein.

In another aspect, the invention pertains to a method of providing an anti-tumor immunity in a subject comprising administering to the subject an effective amount of a cell comprising a CAR molecule, e.g., a cell expressing a CAR molecule described herein. In one embodiment, the cell is an autologous T cell or NK cell. In one embodiment, the cell is an allogeneic T cell or NK cell. In one embodiment, the subject is a human.

In one aspect, the invention includes a population of autologous cells that are transfected or transduced with a vector comprising a nucleic acid molecule encoding a CAR molecule, e.g., as described herein. In one embodiment, the vector is a retroviral vector. In one embodiment, the vector is a self-inactivating lentiviral vector as described elsewhere herein. In one embodiment, the vector is delivered (e.g., by transfecting or electroporating) to a cell, e.g., a T cell or a NK cell, wherein the vector comprises a nucleic acid molecule encoding a CAR of the present invention as described herein, which is transcribed as an mRNA molecule, and the CARs of the present invention is translated from the RNA molecule and expressed on the surface of the cell.

In another aspect, the present invention provides a population of CAR-expressing cells, e.g., CAR-expressing immune effector cells (e.g., T cells or NK cells). In some embodiments, the population of CAR-expressing cells comprises a mixture of cells expressing different CARs. For example, in one embodiment, the population of CAR-expressing immune effector cells (e.g., T cells or NK cells) can include a first cell expressing a CAR having an antigen binding domain that binds to a first tumor antigen as described herein, and a second cell expressing a CAR having a different antigen binding domain that binds to a second tumor antigen as described herein. As another example, the population of CAR-expressing cells can include a first cell expressing a CAR that includes an antigen binding domain that binds to a tumor antigen as described herein, and a second cell expressing a CAR that includes an antigen binding domain to a target other than a tumor antigen as described herein. In one embodiment, the population of CAR-expressing cells includes, e.g., a first cell expressing a CAR that includes a primary intracellular signaling domain, and a second cell expressing a CAR that includes a secondary signaling domain, e.g., a costimulatory signaling domain.

In another aspect, the present invention provides a population of cells wherein at least one cell in the population expresses a CAR having an antigen binding domain that binds to a tumor antigen as described herein, and a second cell expressing another agent, e.g., an agent which enhances the activity of a CAR-expressing cell. For example, in one embodiment, the agent can be an agent which inhibits an inhibitory molecule. Examples of inhibitory molecules include PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGF beta. In one embodiment, the agent which inhibits an inhibitory molecule, e.g., is a molecule described herein, e.g., an agent that comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, LAG-3, CTLA-4, CD160, BTLA, LAIR1, TIM-3, CEACAM (e.g., CEACAM-1, CEACAM-3 and/or CEACAM-5), 2B4 and TIGIT, or a fragment of any of these, and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD-1 or a fragment thereof, and a second polypeptide of an intracellular signaling domain described herein (e.g., a CD28, CD27, OX40 or 4-1BB signaling domain described herein and/or a CD3 zeta signaling domain described herein).

In one embodiment, the nucleic acid molecule encoding a CAR of the present invention molecule, e.g., as described herein, is expressed as an mRNA molecule. In one embodiment, the genetically modified CAR of the present invention-expressing cells, e.g., immune effector cells (e.g., T cells, NK cells), can be generated by transfecting or electroporating an RNA molecule encoding the desired CARS (e.g., without a vector sequence) into the cell. In one embodiment, a CAR of the present invention molecule is translated from the RNA molecule once it is incorporated and expressed on the surface of the recombinant cell.

A method for generating mRNA for use in transfection involves in vitro transcription (IVT) of a template with specially designed primers, followed by polyA addition, to produce a construct containing 3' and 5' untranslated sequence ("UTR") (e.g., a 3' and/or 5' UTR described herein), a 5' cap (e.g., a 5' cap described herein) and/or Internal Ribosome Entry Site (IRES) (e.g., an IRES described herein), the nucleic acid to be expressed, and a polyA tail, typically 50-2000 bases in length (SEQ ID NO: 6638). RNA so produced can efficiently transfect different kinds of cells. In one embodiment, the template includes sequences for the CAR. In an embodiment, an RNA CAR vector is transduced into a cell, e.g., a T cell or a NK cell, by electroporation.

XII. Methods of Manufacture

The disclosure provides methods of manufacturing cells, e.g., T cells, e.g., allogeneic T cells, e.g., CAR-engineered cells modified, or to be modified, with the gRNA molecules described herein.

Introduction of CRISPR Systems

The invention comprises cells, e.g immune effector cells, e.g., allogeneic or autologous cells, which comprise, or at one time comprised, one or more gRNA molecules as described herein. The CRISPR systems described herein may be introduced into the cells by any of the methods described herein. The cells may further be engineered to express a CAR as described herein.

In one aspect, the disclosure provides a method for making a cell comprising:
 a) introducing a gRNA molecule, or nucleic acid encoding said gRNA molecule, as described herein into said cell;
 b) introducing a Cas9 molecule as described herein, or nucleic acid encoding said Cas9 molecule, into said cell;
 c) introducing nucleic acid encoding a CAR into said cell; and
 d) expanding and activating the cells.

In embodiments, the introduction of a) and b) occur before steps c) and d). In embodiments, the introduction of c) occurs before the introduction of a) and b). In embodiments, the introduction of c) and the expanding and activating of d) occurs before the introduction of a) and b). In embodiments, the method further comprises e) selecting the cells which are CAR-expressing. In embodiments, the method further comprises f) selecting the cells which have no or reduced expression of the gene targeted by the gRNA molecule of step a). For example, if the gRNA molecule comprises a targeting domain complementary to a target sequence in the TRAC gene (e.g., comprises a targeting domain comprising any one of SEQ ID NO: 5816 to SEQ ID NO: 5965 or SEQ ID NO: 5528 to SEQ ID NO: 5623), after the introduction of a) and b), cells which lack TCR expression (e.g., as detectible by, for example, an anti-CD3 antibody) may be sorted for further application in the methods of manufacture as described herein, or for further application in the therapeutic methods described herein. Such sorting may be done by methods known in the art such as cell sorting or mechanical separation (e.g., separation by magnetic bead-bound anti-CD3 antibody to remove those cells still expressing CD3/TCR).

Expansion and Activation of Cells

Immune effector cells such as T cells may be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005, each of which is incorporated by reference in its entirety.

Generally, a population of immune effector cells e.g., T regulatory cell depleted cells, may be expanded by contact with a surface having attached thereto an agent that stimulates a CD3/TCR complex associated signal and a ligand that stimulates a costimulatory molecule on the surface of the T cells. In particular, T cell populations may be stimulated as described herein, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody can be used. Examples of an anti-CD28 antibody include 9.3, B-T3, XR-CD28 (Diaclone, Besancon, France) can be used as can other methods commonly known in the art (Berg et al., Transplant Proc. 1998; Haanen et al., J. Exp. Med. 190(9):13191328, 1999; Garland et al., J. Immunol Meth. 227(1-2):53-63, 1999).

In embodiments in which the cells have reduced or absent levels of expression or levels of a component of the TCR, activation may be achieved through means other than interaction with CD3. In cells which further express a CAR, activation may be achieved by contacting said cells with the antigen bound by the antigen-binding domain of the CAR, or a fragment thereof capable of binding the CAR. Such antigen or fragment thereof may be present on, for example, an antibody scaffold, a cell (e.g., an antigen presenting cell, e.g., a cell which naturally expresses said antigen or one which has been artificially engineered to express said antigen on its cell surface), or a solid support such as a bead or membrane.

In certain aspects, the primary stimulatory signal and the costimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In one aspect, the agent providing the costimulatory signal is bound to a cell surface and the agent providing the primary activation signal is in solution or coupled to a surface. In certain aspects, both agents can be in solution. In one aspect, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present invention.

In one aspect, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the costimulatory signal is an anti-CD28 antibody or antigen-binding fragment thereof; and both agents are co-immobilized to the same bead in equivalent molecular amounts. In one aspect, a 1:1 ratio of each antibody bound to the beads for CD4+ T cell expansion and T cell growth is used. In certain aspects of the present invention, a ratio of anti CD3:CD28 antibodies bound to the beads is used such that an increase in T cell expansion is observed as compared to the expansion observed using a ratio of 1:1. In one particular aspect an increase of from about 1 to about 3 fold is observed as compared to the expansion observed using a ratio of 1:1. In one aspect, the ratio of CD3:CD28 antibody bound to the beads ranges from 100:1 to 1:100 and all integer values there between. In one aspect, more anti-CD28 antibody is bound to the particles than anti-CD3 antibody, i.e., the ratio of CD3:CD28 is less than one. In certain aspects, the ratio of anti CD28 antibody to anti CD3 antibody bound to the beads is greater than 2:1. In one particular aspect, a 1:100 CD3:CD28 ratio of antibody bound to beads is used. In one aspect, a 1:75 CD3:CD28 ratio of antibody bound to beads is used. In a further aspect, a 1:50 CD3:CD28 ratio of antibody bound to beads is used. In one aspect, a 1:30 CD3:CD28 ratio of antibody bound to beads is used. In one preferred aspect, a 1:10 CD3:CD28 ratio of antibody bound to beads is used. In one aspect, a 1:3 CD3:CD28 ratio of antibody bound to the beads is used. In yet one aspect, a 3:1 CD3:CD28 ratio of antibody bound to the beads is used.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain aspects the ratio of cells to particles ranges from 1:100 to 100:1 and any integer values in-between and in further aspects the ratio comprises 1:9 to 9:1 and any integer values in between, can also be used to stimulate T cells. The ratio of anti-CD3- and anti-CD28-coupled particles to T cells that result in T cell stimulation can vary as noted above, however certain preferred values include 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, and 15:1 with one preferred ratio being at least 1:1 particles per T cell. In one aspect, a ratio of particles to cells of 1:1 or less is used. In one particular aspect, a preferred particle:cell ratio is 1:5. In further aspects, the ratio of particles to cells can be varied depending on the day of stimulation. For example, in one aspect, the ratio of particles to cells is from 1:1 to 10:1 on the first day and additional particles are added to the cells every day or every other day thereafter for up to 10 days, at final ratios of from 1:1 to 1:10 (based on cell counts on the day of addition). In one particular aspect, the ratio of particles to cells is 1:1 on the first day of stimulation and adjusted to 1:5 on the third and fifth days of stimulation. In one aspect, particles are added on a daily or every other day basis to a final ratio of 1:1 on the first day, and 1:5 on the third and fifth days of stimulation. In one aspect, the ratio of particles to cells is 2:1 on the first day of stimulation and adjusted to 1:10 on the third and fifth days of stimulation. In one aspect, particles are added on a daily or every other day basis to a final ratio of 1:1 on the first day, and 1:10 on the third and fifth days of stimulation. One of skill in the art will appreciate that a variety of other ratios may be suitable for use in the present invention. In particular, ratios will vary depending on particle size and on cell size and type. In one aspect, the most typical ratios for use are in the neighborhood of 1:1, 2:1 and 3:1 on the first day.

In further aspects, the cells, such as T cells, are combined with agent-coated beads, the beads and the cells are subsequently separated, and then the cells are cultured. In an alternative aspect, prior to culture, the agent-coated beads and cells are not separated but are cultured together. In a further aspect, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached (3×28 beads) to contact the T cells. In one aspect the cells (for example, $10^4$ to $10^9$ T cells) and beads (for example, DYNABEADS® M-450 CD3/CD28 T paramagnetic beads at a ratio of 1:1) are combined in a buffer, for example PBS (without divalent cations such as, calcium and magnesium). Again, those of ordinary skill in the art can readily appreciate any cell concentration may be used. For example, the target cell may be very rare in the sample and comprise only 0.01% of the sample or the entire sample (i.e., 100%) may comprise the target cell of interest. Accordingly, any cell number is within the context of the present invention. In certain aspects, it may be desirable to significantly decrease the volume in which particles and cells are mixed together (i.e., increase the concentration of cells), to ensure maximum contact of cells and particles. For example, in one aspect, a concentration of about 10 billion cells/ml, 9 billion/ml, 8 billion/ml, 7 billion/ml, 6 billion/ml, 5 billion/ml, or 2 billion cells/ml is used. In one aspect, greater than 100 million cells/ml is used. In a further aspect, a concentration of cells of 10, 15, 20, 25, 30, 35, 40, 45, or 50 million cells/ml is used. In yet one aspect, a concentration of cells from 75, 80, 85, 90, 95, or 100 million cells/ml is used. In further aspects, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells. Such populations of cells may have therapeutic value and would be desirable to obtain in certain aspects. For example, using high concentration of cells allows more efficient selection of CD8+ T cells that normally have weaker CD28 expression.

In one embodiment, cells of the invention, e.g., cells comprising or which at any time comprised or will comprise a gRNA molecule as described herein, e.g., said cells transduced with a nucleic acid encoding a CAR, e.g., a CAR described herein, are expanded, e.g., by a method described herein. In one embodiment, the cells are expanded in culture for a period of several hours (e.g., about 2, 3, 4, 5, 6, 7, 8, 9, 10, 15, 18, 21 hours) to about 14 days (e.g., 1, 2, 3, 4, 5, 6, 7, 8, 9, 10, 11, 12, 13 or 14 days). In one embodiment, the cells are expanded for a period of 4 to 9 days. In one embodiment, the cells are expanded for a period of 8 days or less, e.g., 7, 6 or 5 days. In one embodiment, the cells are expanded in culture for 5 days, and the resulting cells are more potent than the same cells expanded in culture for 9 days under the same culture conditions. Potency can be defined, e.g., by various T cell functions, e.g. proliferation, target cell killing, cytokine production, activation, migration, or combinations thereof. In one embodiment, the cells are expanded for 5 days show at least a one, two, three or four fold increase in cells doublings upon antigen stimulation as compared to the same cells expanded in culture for 9 days under the same culture conditions. In one embodiment, the cells are expanded in culture for 5 days, and the resulting cells exhibit higher proinflammatory cytokine production, e.g., IFN-γ and/or GM-CSF levels, as compared to the same cells expanded in culture for 9 days under the same culture conditions. In one embodiment, the cells expanded for 5 days show at least a one, two, three, four, five, ten fold or more increase in pg/ml of proinflammatory cytokine production, e.g., IFN-γ and/or GM-CSF levels, as compared to the same cells expanded in culture for 9 days under the same culture conditions.

Several cycles of stimulation may also be desired such that culture time of T cells can be 60 days or more. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$).

In one embodiment, the cells are expanded in an appropriate media (e.g., media described herein) that includes one or more interleukin that result in at least a 200-fold (e.g., 200-fold, 250-fold, 300-fold, 350-fold) increase in cells over a 14 day expansion period, e.g., as measured by a method described herein such as flow cytometry. In one embodiment, the cells are expanded in the presence of IL-15 and/or IL-7 (e.g., IL-15 and IL-7).

In embodiments, methods described herein, manufacturing methods for cells of the invention, e.g., cells comprising or which at any time comprised or will comprise a gRNA molecule as described herein, e.g., said cells expressing a CAR, comprise removing T regulatory cells, e.g., CD25+ T cells, from a cell population, e.g., using an anti-CD25 antibody, or fragment thereof, or a CD25-binding ligand, IL-2. Methods of removing T regulatory cells, e.g., CD25+ T cells, from a cell population are described herein.

In embodiments, the methods, e.g., manufacturing methods, further comprise contacting a cell population (e.g., a cell population in which T regulatory cells, such as CD25+ T cells, have been depleted; or a cell population that has previously contacted an anti-CD25 antibody, fragment thereof, or CD25-binding ligand) with IL-15 and/or IL-7. For example, the cell population (e.g., that has previously contacted an anti-CD25 antibody, fragment thereof, or CD25-binding ligand) is expanded in the presence of IL-15 and/or IL-7.

In some embodiments the cells of the invention, e.g., cells comprising or which at any time comprised or will comprise a gRNA molecule as described herein, e.g., said cells expressing a CAR as described herein, are contacted with a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15, during the manufacturing of the CAR-expressing cell, e.g., ex vivo. In embodiments, a cell described herein is contacted with a composition comprising a IL-15 polypeptide during the manufacturing of the cell, e.g., ex vivo. In embodiments, a cell described herein is contacted with a composition comprising a combination of both a IL-15 polypeptide and a IL-15 Ra polypeptide during the manufacturing of the CAR-expressing cell, e.g., ex vivo. In embodiments, a cell described herein is contacted with a composition comprising hetIL-15 during the manufacturing of the CAR-expressing cell, e.g., ex vivo.

In one embodiment the cells of the invention, e.g., cells comprising or which at any time comprised or will comprise a gRNA molecule as described herein, e.g., said cells expressing a CAR as described herein, is contacted with a composition comprising hetIL-15 during ex vivo expansion. In an embodiment, the cell described herein is contacted with a composition comprising an IL-15 polypeptide during ex vivo expansion. In an embodiment, the CAR-expressing cell described herein is contacted with a composition comprising both an IL-15 polypeptide and an IL-15Ra polypeptide during ex vivo expansion. In one embodiment the contacting results in the survival and proliferation of a lymphocyte subpopulation, e.g., CD8+ T cells.

T cells that have been exposed to varied stimulation times may exhibit different characteristics. For example, typical blood or apheresed peripheral blood mononuclear cell products have a helper T cell population (TH, CD4+) that is greater than the cytotoxic or suppressor T cell population (TC, CD8+). Ex vivo expansion of T cells by stimulating CD3 and CD28 receptors produces a population of T cells that prior to about days 8-9 consists predominately of TH cells, while after about days 8-9, the population of T cells comprises an increasingly greater population of TC cells. Accordingly, depending on the purpose of treatment, infusing a subject with a T cell population comprising predominately of TH cells may be advantageous. Similarly, if an antigen-specific subset of TC cells has been isolated it may be beneficial to expand this subset to a greater degree.

Further, in addition to CD4 and CD8 markers, other phenotypic markers vary significantly, but in large part, reproducibly during the course of the cell expansion process. Thus, such reproducibility enables the ability to tailor an activated T cell product for specific purposes.

Once a cell of the invention has been engineered to express a CAR described herein is constructed, various assays can be used to evaluate the activity of the molecule, such as but not limited to, the ability to expand T cells following antigen stimulation, sustain T cell expansion in the absence of re-stimulation, and anti-cancer activities in appropriate in vitro and animal models. Assays to evaluate the effects of a cars of the present invention are described in further detail below Western blot analysis of CAR expression in primary T cells can be used to detect the presence of monomers and dimers. See, e.g., Milone et al., Molecular Therapy 17(8): 1453-1464 (2009). Very briefly, T cells (1:1 mixture of $CD4^+$ and $CD8^+$ T cells) expressing the CARs are expanded in vitro for more than 10 days followed by lysis and SDS-PAGE under reducing conditions. CARs containing the full length TCR-ζ cytoplasmic domain and the endogenous TCR-ζ chain are detected by western blotting using an antibody to the TCR-ζ chain. The same T cell subsets are used for SDS-PAGE analysis under non-reducing conditions to permit evaluation of covalent dimer formation.

In vitro expansion of CARP T cells following antigen stimulation can be measured by flow cytometry. For example, a mixture of $CD4^+$ and $CD8^+$ T cells are stimulated with αCD3/αCD28 aAPCs followed by transduction with lentiviral vectors expressing GFP under the control of promoters to be analyzed. Exemplary promoters include the CMV IE gene, EF-1α, ubiquitin C, or phosphoglycerokinase (PGK) promoters. GFP fluorescence is evaluated on day 6 of culture in the CD4+ and/or CD8+ T cell subsets by flow cytometry. See, e.g., Milone et al., Molecular Therapy 17(8): 1453-1464 (2009). Alternatively, a mixture of CD4+ and CD8' T cells are stimulated with αCD3/αCD28 coated magnetic beads on day 0, and transduced with CAR on day 1 using a bicistronic lentiviral vector expressing CAR along with eGFP using a 2A ribosomal skipping sequence. Cultures are re-stimulated with either a cancer associated antigen as described herein+ K562 cells (K562 expressing a cancer associated antigen as described herein), wild-type K562 cells (K562 wild type) or K562 cells expressing hCD32 and 4-1BBL in the presence of antiCD3 and anti-CD28 antibody (K562-BBL-3/28) following washing. Exogenous IL-2 is added to the cultures every other day at 100 IU/ml. GFP+ T cells are enumerated by flow cytometry using bead-based counting. See, e.g., Milone et al., Molecular Therapy 17(8): 1453-1464 (2009).

Sustained CAR+ T cell expansion in the absence of re-stimulation can also be measured. See, e.g., Milone et al., Molecular Therapy 17(8): 1453-1464 (2009). Briefly, mean T cell volume (fl) is measured on day 8 of culture using a Coulter Multisizer III particle counter, a Nexcelom Cellometer Vision or Millipore Scepter, following stimulation with αCD3/αCD28 coated magnetic beads on day 0, and transduction with the indicated CAR on day 1.

Animal models can also be used to measure a CART activity. For example, xenograft model using human a cancer associated antigen described herein-specific CARP T cells to treat a primary human pre-B ALL in immunodeficient mice can be used. See, e.g., Milone et al., Molecular Therapy 17(8): 1453-1464 (2009). Very briefly, after establishment of ALL, mice are randomized as to treatment groups. Different numbers of a cancer associated antigen-specific CAR engineered T cells are coinjected at a 1:1 ratio into NOD-SCID-$\gamma^{-/-}$ mice bearing B-ALL. The number of copies of a cancer associated antigen-specific CAR vector in spleen DNA from mice is evaluated at various times following T cell injection. Animals are assessed for leukemia at weekly intervals. Peripheral blood a cancer associate antigen as described herein+ B-ALL blast cell counts are measured in mice that are injected with a cancer associated antigen described herein-ζ CAR+ T cells or mock-transduced T cells. Survival curves for the groups are compared using the log-rank test. In addition, absolute peripheral blood CD4+ and CD8+ T cell counts 4 weeks following T cell injection in NOD-SCID-$\gamma^{-/-}$ mice can also be analyzed. Mice are injected with leukemic cells and 3 weeks later are injected with T cells engineered to express CAR by a bicistronic lentiviral vector that encodes the CAR linked to eGFP. T cells are normalized to 45-50% input GFP+ T cells by mixing with mock-transduced cells prior to injection, and confirmed by flow cytometry. Animals are assessed for leukemia at 1-week intervals. Survival curves for the CAR+ T cell groups are compared using the log-rank test.

Dose dependent CAR treatment response can be evaluated. See, e.g., Milone et al., Molecular Therapy 17(8): 1453-1464 (2009). For example, peripheral blood is obtained 35-70 days after establishing leukemia in mice injected on day 21 with CAR T cells, an equivalent number of mock-transduced T cells, or no T cells. Mice from each group are randomly bled for determination of peripheral blood a cancer associate antigen as described herein+ ALL blast counts and then killed on days 35 and 49. The remaining animals are evaluated on days 57 and 70.

Assessment of cell proliferation and cytokine production has been previously described, e.g., at Milone et al., Molecular Therapy 17(8): 1453-1464 (2009). Briefly, assessment of CAR-mediated proliferation is performed in microtiter plates by mixing washed T cells with K562 cells expressing a cancer associated antigen described herein (K19) or CD32 and CD137 (KT32-BBL) for a final T-cell:K562 ratio of 2:1. K562 cells are irradiated with gamma-radiation prior to use. Anti-CD3 (clone OKT3) and anti-CD28 (clone 9.3) monoclonal antibodies are added to cultures with KT32-BBL cells to serve as a positive control for stimulating T-cell proliferation since these signals support long-term CD8+ T cell expansion ex vivo. T cells are enumerated in cultures using CountBright™ fluorescent beads (Invitrogen, Carlsbad, CA) and flow cytometry as described by the manufacturer. CAR+ T cells are identified by GFP expression using T cells that are engineered with eGFP-2A linked CAR-expressing lentiviral vectors. For CAR+ T cells not expressing GFP, the CAR+ T cells are detected with biotinylated recombinant a cancer associate antigen as described herein protein and a secondary avidin-PE conjugate. CD4+ and CD8+ expression on T cells are also simultaneously detected with specific monoclonal antibodies (BD Biosciences). Cytokine measurements are performed on supernatants collected 24 hours following re-stimulation using the human TH1/TH2 cytokine cytometric bead array kit (BD Biosciences, San Diego, CA) according the manufacturer's instructions. Fluorescence is assessed using a FACScalibur flow cytometer, and data is analyzed according to the manufacturer's instructions.

Cytotoxicity can be assessed by a standard 51Cr-release assay. See, e.g., Milone et al., Molecular Therapy 17(8): 1453-1464 (2009). Briefly, target cells (K562 lines and primary pro-B-ALL cells) are loaded with 51Cr (as NaCrO4, New England Nuclear, Boston, MA) at 37° C. for 2 hours with frequent agitation, washed twice in complete RPMI and plated into microtiter plates. Effector T cells are mixed with target cells in the wells in complete RPMI at varying ratios of effector cell:target cell (E:T). Additional wells containing media only (spontaneous release, SR) or a 1% solution of triton-X 100 detergent (total release, TR) are also prepared. After 4 hours of incubation at 37° C., supernatant from each well is harvested. Released 51Cr is then measured using a gamma particle counter (Packard Instrument Co., Waltham, MA). Each condition is performed in at least triplicate, and the percentage of lysis is calculated using the formula: % Lysis=(ER−SR)/(TR−SR), where ER represents the average 51Cr released for each experimental condition.

Imaging technologies can be used to evaluate specific trafficking and proliferation of CARs in tumor-bearing animal models. Such assays have been described, for example, in Barrett et al., Human Gene Therapy 22:1575-1586 (2011). Briefly, NOD/SCID/$\gamma c^{-/-}$ (NSG) mice are injected IV with Nalm-6 cells followed 7 days later with T cells 4 hour after electroporation with the CAR constructs. The T cells are stably transfected with a lentiviral construct to express firefly luciferase, and mice are imaged for bioluminescence. Alternatively, therapeutic efficacy and specificity of a single injection of CAR P T cells in Nalm-6 xenograft model can be measured as the following: NSG mice are injected with Nalm-6 transduced to stably express firefly luciferase, followed by a single tail-vein injection of T cells electroporated with cars of the present invention 7 days later. Animals are imaged at various time points post injection. For example, photon-density heat maps of firefly luciferase positive leukemia in representative mice at day 5 (2 days before treatment) and day 8 (24 hr post CAR+ PBLs) can be generated.

Other assays, including those described in the Example section herein as well as those that are known in the art can also be used to evaluate the cells and cells expressing CARs described herein.

Delivery Timing

In an embodiment, one or more nucleic acid molecules (e.g., DNA molecules) other than the components of a Cas system, e.g., the Cas9 molecule component and/or the gRNA molecule component described herein, are delivered. In an embodiment, the nucleic acid molecule is delivered at the same time as one or more of the components of the Cas system are delivered. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas system are delivered. In an embodiment, the nucleic acid molecule is delivered by a different means than one or more of the components of the Cas system, e.g., the Cas9 molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 molecule component and/or the gRNA molecule component can be delivered by electroporation, e.g., such that the toxicity caused by nucleic acids (e.g., DNAs) can be reduced. In an embodiment, the nucleic acid molecule encodes a therapeutic protein, e.g., a protein described herein. In an embodiment, the nucleic acid molecule encodes an RNA molecule, e.g, an RNA molecule described herein.

Bi-Modal or Differential Delivery of Components

Separate delivery of the components of a Cas system, e.g., the Cas9 molecule component and the gRNA molecule component, and more particularly, delivery of the components by differing modes, can enhance performance, e.g., by improving tissue specificity and safety. In an embodiment, the Cas9 molecule and the gRNA molecule are delivered by different modes, or as sometimes referred to herein as differential modes. Different or differential modes, as used herein, refer modes of delivery, that confer different pharmacodynamic or pharmacokinetic properties on the subject component molecule, e.g., a Cas9 molecule, gRNA molecule, template nucleic acid, or payload. E.g., the modes of delivery can result in different tissue distribution, different half-life, or different temporal distribution, e.g., in a selected compartment, tissue, or organ.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., adeno associated virus or lentivirus, delivery.

By way of example, the components, e.g., a Cas9 molecule and a gRNA molecule, can be delivered by modes that differ in terms of resulting half life or persistent of the delivered component the body, or in a particular compartment, tissue or organ. In an embodiment, a gRNA molecule can be delivered by such modes. The Cas9 molecule component can be delivered by a mode which results in less persistence or less exposure of its to the body or a particular compartment or tissue or organ.

More generally, in an embodiment, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In an embodiment, the first pharmacodynamic or pharmacokinetic property, e.g., distribution, persistence or exposure, is more limited than the second pharmacodynamic or pharmacokinetic property.

In an embodiment, the first mode of delivery is selected to optimize, e.g., minimize, a pharmacodynamic or pharmacokinetic property, e.g., distribution, persistence or exposure.

In an embodiment, the second mode of delivery is selected to optimize, e.g., maximize, a pharmacodynamic or pharmcokinetic property, e.g., distribution, persistence or exposure.

In an embodiment, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In an embodiment, the second mode of delivery comprises a relatively transient element, e.g., an RNA or protein.

In an embodiment, the first component comprises gRNA, and the delivery mode is relatively persistent, e.g., the gRNA is transcribed from a plasmid or viral vector, e.g., an AAV or lentivirus. Transcription of these genes would be of little physiological consequence because the genes do not encode for a protein product, and the gR As are incapable of acting in isolation. The second component, a Cas9 molecule, is delivered in a transient manner, for example as mRNA or as protein, ensuring that the full Cas9 molecule/gRNA molecule complex is only present and active for a short period of time.

Furthermore, the components can be delivered in different molecular form or with different delivery vectors that complement one another to enhance safety and tissue specificity.

Use of differential delivery modes can enhance performance, safety and efficacy. For example, the likelihood of an eventual off-target modification can be reduced. Delivery of immunogenic components, e.g., Cas9 molecules, by less persistent modes can reduce immunogenicity, as peptides from the bacterially-derived Cas enzyme are displayed on the surface of the cell by MHC molecules. A two-part delivery system can alleviate these drawbacks.

Differential delivery modes can be used to deliver components to different, but overlapping target regions. The formation active complex is minimized outside the overlap of the target regions. Thus, in an embodiment, a first component, e.g., a gRNA molecule is delivered by a first delivery mode that results in a first spatial, e.g., tissue, distribution. A second component, e.g., a Cas9 molecule is delivered by a second delivery mode that results in a second spatial, e.g., tissue, distribution. In an embodiment, the first mode comprises a first element selected from a liposome, nanoparticle, e.g., polymeric nanoparticle, and a nucleic acid, e.g., viral vector. The second mode comprises a second element selected from the group. In an embodiment, the first mode of delivery comprises a first targeting element, e.g., a cell specific receptor or an antibody, and the second mode of delivery does not include that element. In an embodiment, the second mode of delivery comprises a second targeting element, e.g., a second cell specific receptor or second antibody.

When the Cas9 molecule is delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA molecule and the Cas9 molecule are packaged in separated delivery vehicles with distinct but overlapping tissue tropism, the fully functional complex is only be formed in the tissue that is targeted by both vectors.

In one aspect, the delivery is accomplished ex vivo.

XIII. Modified Nucleosides, Nucleotides, and Nucleic Acids

Modified nucleosides and modified nucleotides can be present in nucleic acids, e.g., particularly gRNA, but also other forms of RNA, e.g., mRNA, RNAi, or siRNA. As described herein "nucleoside" is defined as a compound containing a five-carbon sugar molecule (a pentose or ribose) or derivative thereof, and an organic base, purine or pyrimidine, or a derivative thereof. As described herein, "nucleotide" is defined as a nucleoside further comprising a phosphate group.

Modified nucleosides and nucleotides can include one or more of:
  (i) alteration, e.g., replacement, of one or both of the non-linking phosphate oxygens and/or of one or more of the linking phosphate oxygens in the phosphodiester backbone linkage;
  (ii) alteration, e.g., replacement, of a constituent of the ribose sugar, e.g., of the 2' hydroxyl on the ribose sugar;
  (iii) wholesale replacement of the phosphate moiety with "diphospho" linkers;
  (iv) modification or replacement of a naturally occurring nucleobase, including with a non-canonical nucleobase;
  (v) replacement or modification of the ribose-phosphate backbone;
  (vi) modification of the 3' end or 5' end of the oligonucleotide, e.g., removal, modification or replacement of a terminal phosphate group or conjugation of a moiety, cap or linker; and
  (vii) modification or replacement of the sugar.

The modifications listed above can be combined to provide modified nucleosides and nucleotides that can have two, three, four, or more modifications. For example, a modified nucleoside or nucleotide can have a modified sugar and a modified nucleobase. In an embodiment, every base of a gRNA is modified, e.g., all bases have a modified phosphate group, e.g., all are phosphorothioate groups. In an embodiment, all, or substantially all, of the phosphate groups of a unimolecular or modular gRNA molecule are replaced with phosphorothioate groups.

In an embodiment, modified nucleotides, e.g., nucleotides having modifications as described herein, can be incorporated into a nucleic acid, e.g., a "modified nucleic acid." In some embodiments, the modified nucleic acids comprise one, two, three or more modified nucleotides. In some embodiments, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In some embodiments, the modified nucleosides, modified nucleotides, and modified nucleic acids described herein can exhibit a reduced innate immune response when introduced into a population of cells, both in vivo and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In some embodiments, the modified nucleosides, modified nucleotides, and modified nucleic acids described herein can disrupt binding of a major groove interacting partner with the nucleic acid. In some embodiments, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In some embodiments, aryl groups have from 6 to about 20 carbon atoms.

As used herein, "alkenyl" refers to an aliphatic group containing at least one double bond. As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl.

Phosphate Backbone Modifications

The Phosphate Group

In some embodiments, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In some embodiments, the modification of the phosphate backbone can include alterations that result in either an uncharged linker or a charged linker with unsymmetrical charge distribution.

Examples of modified phosphate groups include, phosphorothioate, phosphoroselenates, borano phosphates, borano phosphate esters, hydrogen phosphonates, phosphoroamidates, alkyl or aryl phosphonates and phosphotriesters. In some embodiments, one of the non-bridging phosphate oxygen atoms in the phosphate backbone moiety can be replaced by any of the following groups: sulfur (S), selenium (Se), BR 3 (wherein R can be, e.g., hydrogen, alkyl, or aryl), C (e.g., an alkyl group, an aryl group, and the like), H, NR2 (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide diastereomers. In some embodiments, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

Replacement of the Phosphate Group

The phosphate group can be replaced by non-phosphorus containing connectors. In some embodiments, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetyl, oxime, methyleneimino, methylenemethylimino, methylenehydrazono, methylenedimethylhydrazo and methyleneoxymethylimino.

Replacement of the Ribophosphate Backbone

Scaffolds that can mimic nucleic acids can also be constructed wherein the phosphate linker and ribose sugar are replaced by nuclease resistant nucleoside or nucleotide surrogates. In some embodiments, the nucleobases can be tethered by a surrogate backbone. Examples can include, without limitation, the morpholino, cyclobutyl, pyrrolidine and peptide nucleic acid (PNA) nucleoside surrogates.

Sugar Modifications

The modified nucleosides and modified nucleotides can include one or more modifications to the sugar group. For example, the 2' hydroxyl group (OH) can be modified or replaced with a number of different "oxy" or "deoxy" substituents. In some embodiments, modifications to the 2' hydroxyl group can enhance the stability of the nucleic acid since the hydroxyl can no longer be deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In some embodiments, the "oxy"-2' hydroxyl group modification can include "locked" nucleic acids (LNA) in which the 2' hydroxyl can be connected, e.g., by a $C_{i-6}$ alkylene or $C_{j-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH_2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In some embodiments, the "oxy"-2' hydroxyl group modification can include the methoxyethyl group (MOE), ($OCH_2CH_2OCH_3$, e.g., a PEG derivative).

"Deoxy" modifications can include hydrogen (i.e. deoxyribose sugars, e.g., at the overhang portions of partially ds RNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid); $NH(CH_2CH_2NH)_nCH_2CH_2$-amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the F position on the sugar, e.g., alpha-nucleosides. The modified nucleic acids can also include "abasic" sugars, which lack a nucleobase at C–. These abasic sugars can also be further modified at one or more of the constituent sugar atoms. The modified nucleic acids can also include one or more sugars that are in the L form, e.g. L-nucleosides.

Generally, RNA includes the sugar group ribose, which is a 5-membered ring having an oxygen. Exemplary modified nucleosides and modified nucleotides can include, without limitation, replacement of the oxygen in ribose (e.g., with sulfur (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In some embodiments, the modified nucleotides can include multicyclic forms (e.g., tricyclo; and "unlocked" forms, such as glycol nucleic acid (GNA) (e.g., R-GNA or S-GNA, where ribose is replaced by glycol units attached to phosphodiester bonds), threose nucleic acid (TNA, where ribose is replaced with a-L-threofuranosyl-(3'→2')).

Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In some embodiments, the nucleobase can include, for example, naturally-occurring and synthetic derivatives of a base.

Uracil

In some embodiments, the modified nucleobase is a modified uracil. Exemplary nucleobases and nucleosides having a modified uracil include without limitation pseudouridine (ψ), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-uridine (ho$^5$U), 5-aminoallyl-uridine, 5-halo-uridine (e.g., 5-iodo-uridine or 5-bromo-uridine), 3-methyl-uridine (m$^3$U), 5-methoxy-uridine (mo$^5$U), uridine 5-oxyacetic acid (cmo$^5$U), uridine 5-oxyacetic acid methyl ester (mcmo^U), 5-carboxymethyl-uridine (cm$^5$U), 1-carboxymethyl-pseudouridine, 5-carboxyhydroxymethyl-uridine (chm$^5$U), 5-carboxyhydroxymethyl-uridine methyl ester (mchm$^5$U), 5-methoxycarbonylmethyl-uridine (mcm$^5$U), 5-methoxycarbonylmethyl-2-thio-uridine (mcm$^5$s2U), 5-aminomethyl-2-thio-uridine (nm$^5$s2U), 5-methylaminomethyl-uridine (mnm$^5$U), 5-methylaminomethyl-2-thio-uridine (mnm$^5$s2U), 5-methylaminomethyl-2-seleno-uridine (mnm$^5$se$^2$U), 5-carbamoylmethyl-uridine (ncm$^5$U), 5-carboxymethylaminomethyl-uridine (cmnm$^5$U), 5-carboxymethylaminomethyl-2-thio-uridine (cmnm\s2U), 5-propynyl-uridine, 1-propynyl-pseudouridine, 5-taurinomethyl-uridine (xcm$^5$U), 1-taurinomethyl-pseudouridine, 5-taurinomethyl-2-thio-uridine (Trn$^5$s2U), 1-taurinomethyl-4-thio-pseudouridine, 5-methyl-uridine (m$^5$U, i.e., having the nucleobase deoxythymine), 1-methyl-pseudouridine (ιπι'ψ). 5-methyl-2-thio-uridine (m$^5$s2U), 1-methyl-4-thio-pseudouridine (m's ψ), 4-thio-1-methyl-pseudouridine, 3-methyl-pseudouridine (m'V), 2-thio-1-methyl-pseudouridine, 1-methyl-1-deaza-pseudouridine, 2-thio-1-methyl-1-deaza-pseudouridine, dihydroindene (D), dihydropseudouridine, 5,6-dihydrouridine, 5-methyl-dihydrouridine (m$^5$D), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl) uridine (acp$^3$U), 1-methyl-3-(3-amino-3-carboxypropy pseudouridine 5-(isopentenylaminomethyl)uridine (inm$^5$U), 5-(isopentenylaminomethy])-2-thio-uridine (inm$^5$s2U), a-thio-uridine, 2'-O-methyl-uridine (Urn), 5,2'-O-dimethyl-uridine (m$^5$Um), 2'-O-methyl-pseudouridine (ψπι), 2-thio-2'-O-methyl-uridine (s2Um), 5-methoxycarbonylmethyl-2'-O-methyl-uridine (mcm$^5$Um), 5-carbamoylmethyl-2'-O-methyl-uridine (ncm$^5$Um), 5-carboxymethylaminomethyl-2'-O-methyl-uridine (cmnm$^5$Um), 3,2'-O-dimethyl-uridine (m$^3$Um), (inm$^5$Um), 1-thio-uridine, deoxythymidine, 2'-F-ara-uridine, 2'-F-uridine, 2'-OH-ara-uridine, 5-(2-carbomethoxyvinyl) uridine, 5-[3-(1-E-propenylamino)uridine, pyrazolo[3,4-d]pyrimidines, xanthine, and hypoxanthine.

Cytosine

In some embodiments, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine (m$^3$C), N4-acetyl-cytidine (act), 5-formyl-cytidine (f$^5$C), N4-methyl-cytidine (m$^4$C), 5-methyl-cytidine (m$^5$C), 5-halo-cytidine (e.g., 5-iodo-cytidine), 5-hydroxymethyl-cytidine (hm$^5$C), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k$^2$C), a-thio-cytidine, 2'-O-methyl-cytidine (Cm), 5,2'-O-dimethyl-cytidine (m$^5$Cm), N4-acetyl-2'-O-methyl-cytidine (ac$^4$Cm), N4,2'-O-dimethyl-cytidine (m$^4$Cm), (f$^5$Cm), N4,N4,2'-O-trimethyl-cytidine (m$^4$₂Cm), 1-thio-cytidine, 2'-F-ara-cytidine, 2'-F-cytidine, and 2'-OH-ara-cytidine.

Adenine

In some embodiments, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloi-purine), 2-amino-6-methyl-purine, 8-azido-adenosine, 7-deaza-adenine, 7-deaza-8-aza-adenine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m'A), 2-methyl-adenine (m A), N6-methyl-adenosine (m$^6$A), 2-methylthio-N6-methyl-adenosine (ms2m$^6$A), N6-isopentenyl-adenosine (i$^6$A), 2-methylthio-N6-isopentenyl-adenosine (ms$^2$i$^6$A), N6-(cis-hydroxyisopentenyl)adenosine (io$^6$A), 2-methylthio-N6-(cis-hydroxy-isopentenyl)adenosine (ms2io$^6$A), N6-glycinylcarbamoyl-adenosine (g$^6$A), N6-threonylcarbamoyl-adenosine (t$^6$A), N6-methyl-N6-threonylcarbamoyl-adenosine (m$^6$t$^6$A), 2-methylthio-N6-threonylcarbamoyl-adenosine (ms$^2$g$^6$A), N6,N6-dimethyl-adenosine (m$^6$₂A), N6-hydroxynorvalyl-carbamoyl-adenosine (hn$^6$A), 2-methylthio-N6-hydroxynorvalylcarbamoyl-adenosine (ms2hn$^6$A), N6-acetyl-adenosine (ac$^6$A), 7-methyl-adenine, 2-methylthio-adenine, 2-methoxy-adenine, a-thio-adenosine, 2'-O-methyl-adenosine (Am), N$^6$,2'-O-dimethyl-adenosine (m$^5$Am), N6-Methyl-2'-deoxyadenosine, N6,N6,2'-O-trimethyl-adenosine (m$^6$₂Am), 1,2'-O-dimethyl-adenosine (m' Am), 2'-O-ribosyladenosine (phosphate) (Ar(p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

Guanine

In some embodiments, the modified nucleobase is a modified guanine. Exemplary nucleobases and nucleosides having a modified guanine include without limitation inosine (I), 1-methyl-inosine (m'1), wyosine (imG), methyl-wyosine (mimG), 4-demethyl-wyosine (imG-14), isowyosine (imG2), wybutosine (yW), peroxywybutosine (o$_2$yW), hydroxywybutosine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQ$_0$), 7-aminomethyl-7-deaza-guanosine (preQi), archaeosine (G$^+$), 7-deaza-8-aza-guanosine, 6-thio-guanosine, 6-thio-7-deaza-guanosine, 6-thio-7-deaza-8-aza-guanosine, 7-methyl-guanosine (m$^7$G), 6-thio-7-methyl-guanosine, 7-methyl-inosine, 6-methoxy-guanosine, 1-methyl-guanosine (m'G), N2-methyl-guanosine (m$^2$G), N2,N2-dimethyl-guanosine (m$^2_2$G), N2,7-dimethyl-guanosine (m$^2$,7G), N2,N2,7-dimethyl-guanosine (m$^2$,2,7G), 8-oxo-guanosine, 7-methyl-8-oxo-guanosine, 1-meth thio-guanosine, N2-methyl-6-thio-guanosine, N2,N2-dimethyl-6-thio-guanosine, a-thio-guanosine, 2'-O-methyl-guanosine (Gm), N2-methyl-2'-O-methyl-guanosine (m$^{3/4}$m), N2,N2-dimethyl-2'-O-methyl-guanosine (m$^2_2$Gm), 1-methyl-2'-O-methyl-guanosine (m'Gm), N2,7-dimethyl-2'-O-methyl-guanosine (m$^2$,7Gm), 2'-O-methyl-inosine (Im), 1,2'-O-dimethyl-inosine (m'lm), O$^6$-phenyl-2'-deoxyinosine, 2'-O-ribosylguanosine (phosphate) (Gr(p)), 1-thio-guanosine, O$^6$-methyl]-guanosine, O$^6$-Methyl-2'-deoxyguanosine, 2'-F-ara-guanosine, and 2'-F-guanosine.

Modified gRNAs

In some embodiments, the modified nucleic acids can be modified gRNAs. In some embodiments, gRNAs can be modified at the 3' end. In this embodiment, the gRNAs can be modified at the 3' terminal U ribose. For example, the two terminal hydroxyl groups of the U ribose can be oxidized to aldehyde groups and a concomitant opening of the ribose ring to afford a modified nucleoside, wherein U can be an unmodified or modified uridine.

In another embodiment, the 3' terminal U can be modified with a 2' 3' cyclic phosphate, wherein U can be an unmodified or modified uridine. In some embodiments, the gRNA molecules may contain 3' nucleotides which can be stabilized against degradation, e.g., by incorporating one or more of the modified nucleotides described herein. In this embodiment, e.g., uridines can be replaced with modified uridines, e.g., 5-(2-amino)propyl uridine, and 5-bromo uridine, or with any of the modified uridines described herein; adenosines and guanosines can be replaced with modified adenosines and guanosines, e.g., with modifications at the 8-position, e.g., 8-bromo guanosine, or with any of the modified adenosines or guanosines described herein. In some embodiments, deaza nucleotides, e.g., 7-deaza-adenosine, can be incorporated into the gRNA. In some embodiments, O- and N-alkylated nucleotides, e.g., N6-methyl adenosine, can be incorporated into the gRNA. In some embodiments, sugar-modified ribonucleotides can be incorporated, e.g., wherein the 2' OH— group is replaced by a group selected from H, —OR, —R (wherein R can be, e.g., methyl, alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., NH$_2$; alkylamino, dialkylamino, heterocyclyl, arylamino, diarylamino, heteroarylamino, diheteroarylamino, or amino acid); or cyano (—CN). In some embodiments, the phosphate backbone can be modified as described herein, e.g., with a phosphothioate group. In some embodiments, the nucleotides in the overhang region of the gRNA can each independently be a modified or unmodified nucleotide including, but not limited to 2'-sugar modified, such as, 2-F2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof.

In an embodiment, a one or more or all of the nucleotides in single stranded overhang of an RNA molecule, e.g., a gRNA molecule, are deoxynucleotides.

Candidate Cas molecules, e.g., Cas9 molecules, candidate gRNA molecules, candidate Cas9 molecule/gRNA molecule complexes, and candidate CRISPR systems, can be evaluated by art-known methods or as described herein. For example, exemplary methods for evaluating the endonuclease activity of Cas9 molecule are described, e.g., in Jinek el al., SCIENCE 2012; 337(6096):816-821.

EXAMPLES

Example 1: Assays

Guide Selection

Initial guide selection was performed in silico using a human reference genome and user defined genomic regions of interest (e.g., a gene, an exon of a gene, non-coding regulatory region, etc), for identifying PAMs in the regions of interest. For each identified PAM, analyses were performed and statistics reported. gRNA molecules were further selected and rank-ordered based on a number of criteria known in the art. gRNA molecules were then tested as described herein for cutting efficiency and indel formation as described herein.

Throughout the Examples, in the experiments below, either sgRNA molecules or dgRNA molecules were used. Unless indicated otherwise, experiments referring to a CRxxxxx identifier for the targeting domain employed a dgRNA format. Unless indicated otherwise, where dgRNA molecules were used, the gRNA includes the following:

crRNA: [targeting domain]-[SEQ ID NO: 6607]
tracr (trRNA): SEQ ID NO: 6660.

Unless indicated otherwise, in experiments employing a sgRNA molecule, the following sequence was used:

[targeting domain]-[SEQ ID NO: 6601]-UUUU

Transfection of HEK-293_Cas9GFP Cells for Primary Guide Screening

Transfection of Cas9GFP-expressing HEK293 cells (HEK-293_Cas9GFP) was used for primary screening of target specific crRNAs. In this example, target specific crRNAs were designed and selected for primary screening using defined criteria including in silico off-target detection, e.g., as described herein. Selected crRNAs were chemically synthesized and delivered in a 96 well format. HEK-293-Cas9GFP cells were transfected with target crRNAs comprising a flagpole region of SEQ ID NO: 6607 in a 1:1 ratio with stock trRNA of SEQ ID NO: 6660. The transfection was mediated using lipofection technology according to manufacturer's protocol (DharmaFECT Duo, GE Life-Sciences; or RNAiMax, LifeTechnologies). Transfected cells were lysed 24 h following lipofection and editing (e.g., cleavage) was detected within lysates with the T7E1 assay and/or next generation sequencing (NGS; below).

T7E1 Assay

The T7E1 assay was used to detect mutation events in genomic DNA such as insertions, deletions and substitutions created through non-homologous end joining (NHEJ) following DNA cleavage by Cas9 (See Cho et al., Targeted genome engineering in human cells with the Cas9 RNA-guided endonuclease. *Nature Biotechnology.* 2013; 31, 230-232).

Genomic DNA regions that have been targeted for cutting by CRISPR/Cas9 were amplified by PCR, denatured at 95° C. for 10 minutes, and then re-annealed by ramping down from 95° C. to 25° C. at 0.5° C. per second. If mutations were present within the amplified region, the DNA combined to form heteroduplexes. The re-annealed heteroduplexes were then digested with T7E1 (New England Biolabs) at 37° C. for 1 hour. T7E1 endonuclease recognizes DNA mismatches, heteroduplexes and nicked double stranded DNA and generates a double stranded break at these sites. The resulting DNA fragments were analyzed using a Fragment Analyzer and quantified to determine cleavage efficiency.

Next-Generation Sequencing (NGS) and Analysis for On-Target Cleavage Efficiency and Indel Formation To determine the efficiency of editing (e.g., cleaving) the target location in the genome, deep sequencing was utilized to identify the presence of insertions and deletions introduced by non-homologous end joining.

PCR primers were first designed around the target site, and the genomic area of interest PCR amplified. Additional PCR was performed according to manufacturer's protocols (Illumina) to add the necessary chemistry for sequencing. The amplicons were then sequenced on an Illumina MiSeq instrument. The reads were then aligned to the human reference genome (e.g., hg38) after eliminating those having low quality scores. From the resulting files containing the reads mapped to the reference genome (BAM files), reads which overlap the target region of interest were selected and the number of wild type reads versus the number of reads which contain an insertion or deletion was calculated. The editing percentage was then defined as the total number of reads with insertions or deletions over the total number of reads, including wild type. To determine the pattern of insertions and/or deletions that resulted from the edit, the aligned reads with indels were selected and the number of a reads with a given indel were summed. This information was then displayed as a list as well as visualized in the form on histograms which represent the frequency of each indel.

RNP Generation

The addition of crRNA and trRNA (for a dgRNA), or chimeric gRNA (for sgRNA) to Cas9 protein results in the formation of the active Cas9 ribonucleoprotein complex (RNP), which mediates binding to the target region specified by the crRNA and specific cleavage of the targeted genomic DNA. This complex was formed by loading trRNA and crRNA into Cas9, which is believed to cause conformational changes to Cas9 allowing it to bind and cleave dsDNA.

The crRNA and trRNA were separately denatured at 95° C. for 2 minutes, and allowed to come to room temperature. Cas9 protein (10 mg/ml) was added to 5×CCE buffer (20 mM HEPES, 100 mM KCl, $MgCl_2$, 1 mM DTT, 5% glycerol), to which trRNA and crRNAs were added (in separate reactions) and incubated at 37° C. for 10 minutes, thereby forming the active RNP complex. The complex was delivered by electroporation and other methods into a wide variety of cells, including HEK-293 and CD3+ T cells.

Delivery of RNPs to T Cells

CD3+ T cells are comprised of multiple T cell populations including CD4+ T helper cells and CD8+ cytotoxic T cells. These cells can be isolated from whole blood or from leukophoresis samples. T cells can be modified to specifically target cancerous cells and to be less immunogenic, by engineering patient T cells using Cas9-mediated editing. This example describes a basic method used to deliver Cas9 RNP, for example, Cas9 RNP targeting B2M, in T cells. Only the targeting crRNA in the RNP would need to be changed to adapt this protocol to a different T cell target (e.g., any of those provided herein).

T cells were first enriched from a leukopak using a commercially available kit (e.g., EasySep™ Human T Cell Isolation Kit, Stem Cell Technology). Enriched T cells were aliquoted and frozen down (at 10×106/vial) for future use. Vials were subsequently thawed as needed, and activated by addition of 3:1 ratio of CD3/CD28 beads (Dynabeads, Life Technologies) or using ImmunoCult Human CD3/CD28 T cell Activator (Stem Cell Technologies) in T cell media (RPMI 1640, FBS, L-glutamine, non-essential amino acids, sodium pyruvate, HEPES buffer, 2-mercaptoethanol and optionally IL2). RNPs were generated as described herein, and were added to ~50,000-100,000 CD3+ T cells resuspended in P3 buffer and nucleofected using the Amaxa nucleofection program EO-115. T cell media was added to cells immediately post-nucleofection and cultured for 24 h or more.

Example 2: Editing of B2M

Results of Editing Using B2M-Targeted gRNAs in HEK-293 Cells Stably Expressing Cas9

Figure 14:
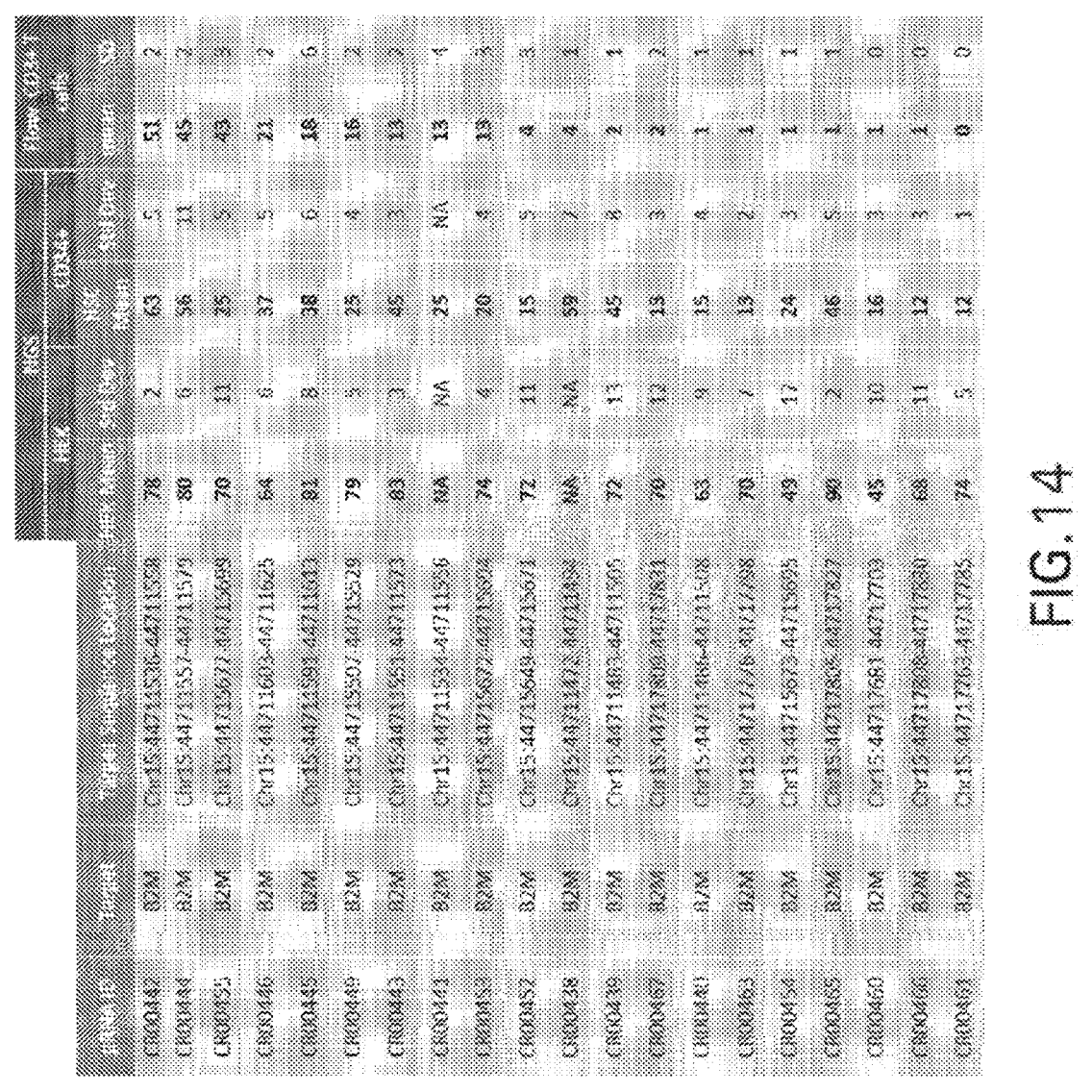

NGS assay results for cutting efficiency of gRNAs targeting B2M are summarized in Table 9, and in FIG. 1. These results demonstrate that multiple guide RNA molecules are able to mediate high efficiency editing of the B2M locus. The top gRNA molecules, as ranked by % editing in HEK cells (followed by % editing in CD34+ cells) are shown in FIG. 14, together with the results of 1) % editing in CD34+ cells as measured by NGS, and 2) % loss of B2M as measured by flow cytometry in CD3+ T cells). As shown in FIG. 14, three dgRNA molecules, e.g., dgRNA molecules that include the targeting domain of CR00442, CR00444 and CR00455 showed greater than 40% editing in CD3+ T cells as measured by flow cytometry.

TABLE 9

Editing of B2M by dgRNA-CRISPR systems in HEK-293 Cas9GFP as determined by NGS. gRNAs are ranked according to % editing in HEK cells.

| gRNA ID | target name | HEK (NGS) % Editing | |
|---|---|---|---|
| | | Mean | Std Dev |
| CR00465 | B2M | 89.7 | 1.7 |
| CR00443 | B2M | 82.9 | 3.2 |
| CR00445 | B2M | 80.9 | 8.4 |
| CR00444 | B2M | 80.4 | 5.8 |
| CR00449 | B2M | 79.3 | 5.1 |
| CR00442 | B2M | 77.7 | 2.1 |
| CR00453 | B2M | 74.3 | 3.6 |
| CR00461 | B2M | 73.6 | 5.2 |
| CR00439 | B2M | 71.8 | 12.5 |
| CR00452 | B2M | 71.7 | 10.6 |
| CR00455 | B2M | 70.4 | 11.1 |
| CR00463 | B2M | 70.2 | 6.7 |
| CR00467 | B2M | 69.6 | 12.5 |
| CR00466 | B2M | 67.6 | 11.4 |

TABLE 9-continued

Editing of B2M by dgRNA-CRISPR systems in HEK-293 Cas9GFP as determined by NGS. gRNAs are ranked according to % editing in HEK cells.

| gRNA ID | target name | HEK (NGS) % Editing | |
|---|---|---|---|
| | | Mean | Std Dev |
| CR00446 | B2M | 64.4 | 6.0 |
| CR00440 | B2M | 62.6 | 9.1 |
| CR00472 | B2M | 57.5 | 4.0 |
| CR00459 | B2M | 55.8 | 19.8 |
| CR00468 | B2M | 54.8 | 11.9 |
| CR00469 | B2M | 52.6 | 13.6 |
| CR00450 | B2M | 51.6 | 4.5 |
| CR00456 | B2M | 50.3 | 9.6 |
| CR00454 | B2M | 49.2 | 16.8 |
| CR00464 | B2M | 47.3 | 8.2 |
| CR00460 | B2M | 45.1 | 9.8 |
| CR00457 | B2M | 43.6 | 11.5 |
| CR00451 | B2M | 39.8 | 8.0 |
| CR00462 | B2M | 34.6 | 9.5 |
| CR00470 | B2M | 31.3 | 7.0 |
| CR00447 | B2M | 31.2 | 7.0 |
| CR00458 | B2M | 20.6 | 9.0 |
| CR00471 | B2M | 17.1 | 4.7 |
| CR00473 | B2M | 15.6 | 2.1 |
| CR000129 | B2M | NA | NA |
| CR000131 | B2M | NA | NA |
| CR00438 | B2M | NA | NA |

Flow Cytometric Analysis of B2M Expression

A flow based assay was developed to monitor editing efficiency following RNP formulation and delivery. Beta-2-microglobin (B2M) is an essential component of the MHC class I (HLA-type 1) complex that is presented on the surface of all nucleated cells. MHC class I presents endogenous (e.g., self and non-self) peptides to the immune system. A series of crRNAs targeting B2M were tested using flow cytometry assay to detect B2M expression. From this initial screen, crRNAs were identified which showed consistent editing ranging between 5-25%.

Cells in suspension were labeled with APC conjugated anti-human B2M (BioLegend, cat #316312), PE conjugated anti-human HLA-A,B,C (BioLegend, cat #311405), and propidium iodide (0.5 mg/ml diluted to 1/1000). Appropriate controls were established (e.g., isotype-APC, isotype-PE, PE-anti-HLA separately, APC-anti-B2M separately). The samples were then run on a flow cytometer. In this example, loss of B2M expression as assessed by surface marker staining was indicative of Cas9-mediated editing (e.g., cleavage). Results are reported in FIG. 14.

Example 3: Editing of TCR and/or PD-1 in T Cells, Including in CAR-T Cells

Table 10 lists gRNA targeting domains for editing of the genes for TCR alpha and for PD-1. gRNA molecules were generated as described below as sgRNAs comprising, from 5' to 3' the indicated targeting domain-SEQ ID NO: 6601-(U)$_7$.

TABLE 10 gRNA targeting domains to TCR alpha and PD-1

| Id. | gRNA Targeting Domain | SEQ ID NO: |
|---|---|---|
| TRAC-1 (CR000960) | UCUCUCAGCUGGUACACGGC | 5568 |
| TRAC-2 (CR000964) | GAGAAUCAAAAUCGGUGAAU | 5572 |
| TRAC-3 (CR000966) | AACAAAUGUGUCACAAAGUA | 5574 |
| TRAC-5 (CR000971) | AAAGUCAGAUUUGUUGCUCC | 5579 |
| TRAC-6 (CR000973) | CUGGGGAAGAAGGUGUCUUC | 5581 |
| TRAC-7 (CR000980) | CUCGACCAGCUUGACAUCAC | 5588 |
| TRAC-8 (CR000979) | AAGUUCCUGUGAUGUCAAGC | 5587 |
| TRAC-9 (CR000984) | UUCGGAACCCAAUCACUGAC | 5592 |
| TRAC-10 (CR000991) | GAUUAAACCCGGCCACUUUC | 5599 |
| PD1-1 (CR000837) | UGUAGCACCGCCCAGACGAC | 5733 |
| PD1-2 (3'-20 nt of 5133_1_37) | UGCAGAUCCCACAGGCGCCC | 6657 |
| PD1-3 (CR000868) | UGACACGGAAGCGGCAGUCC | 5764 |
| PD1-4 (CR000853) | CACGAAGCUCUCCGAUGUGU | 5749 |
| PD1-5 (CR000881) | AGGUGCCGCUGUCAUUGCGC | 5777 |
| PD1-6 | AGGGCCCGGCGCAAUGACAG | 5775 |
| PD1-7 (CR000859) | CAGCAACCAGACGGACAAGC | 5755 |
| PD1-8 (CR000850) | CCUGCUCGUGGUGACCGAAG | 5746 |

Figure 2:
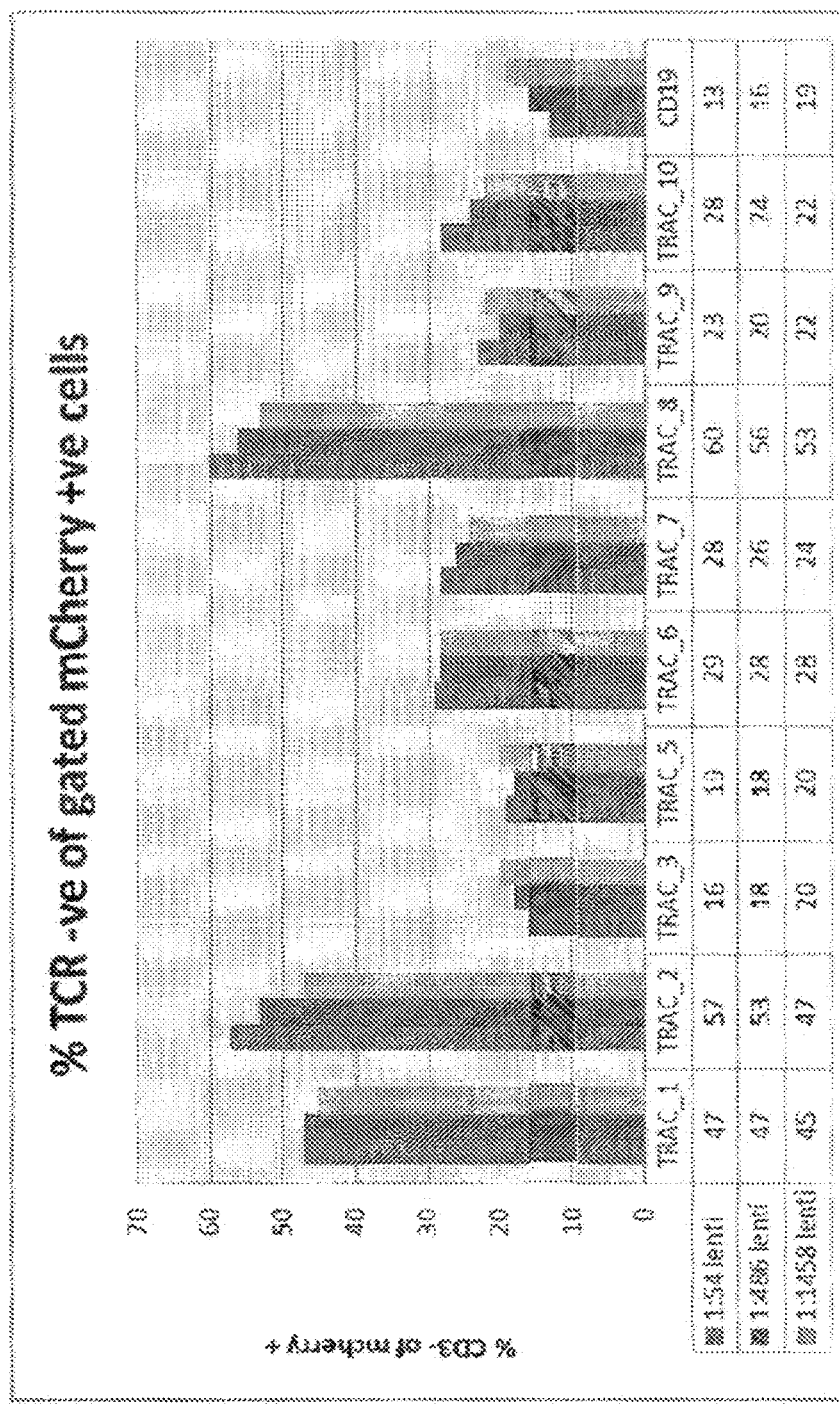
FIG. 2: Histogram for TCR expression after editing with gRNA molecules comprising targeting domains to TCR-alpha, as listed in table 1. Shown is the % mCherry+TCR− cells after 7 days in Jurkat cells, using three different concentrations of lentivirus.

Forward and reverse DNA oligonucleotides encoding gRNA molecules comprising the targeting domains listed above in Table 10 were cloned into a lentiviral vector downstream of a U6 promoter. Using standard procedures, briefly, the vector was digested with BBSI for 1 hour at 37° C. The vector was purified using a PCR-purification kit (Qiagen). The gRNA forward and reverse DNA oligonucleotides were synthesized by IDT (Integrated DNA Technologies) with the addition of BBSI site overhangs (ACCG 5' of the forward oligo and AAAC 5' of the reverse strand). The oligos were annealed using IDT duplex buffer by heating up to 95° C. and letting cool down at room temperature. The annealed oligo was then ligated to the cut and purified vector using NEB quick ligation kit. The vector also contains nucleic acid encoding Cas9 and a mCherry reporter (mCherry is expressed using a T2A sequence downstream of CAS9) downstream of an EF1-alpha promoter. Lentivirus was packaged using a packaging system (Cellecta catalog number CPCP-K2A). The virus was concentrated 200× for all the CRISPR viral productions. In a 96 well flat bottom plate, 1E5 Jurkat cells were plated in 100 ul RPMI 10% FBS media. 50 ul of concentrated virus was added directly to each well. Then 24 hours post viral addition 100 ul of media was added to the cells. Cells were cultured by passaging every 3 days by adding new media to maintain the cells at 0.5e6 cells/mL. Expression of the TCR was measured 7 days post viral transduction. The TCR was detected using anti-CD3 epsilon antibody clone OKT3 conjugated to APC from ebioscience (catalog number 17-0037-42). 1E5 cells were incubated with 2 ul of antibody for 20 minutes, analyzed by flow cytometry (BD Fortessa). Data was analyzed using Flow Jo software. mCherry positive cells were gated first to detect CRISPR/Cas9 positive cells. This population was analyzed for TCR loss. The results are shown in FIG. 2. These results demonstrate that TCR-alpha targeted gRNAs are able to cause loss of surface TCR expression in Jurkat cells.

Generation of TCR-Primary T Cells Using TCR-Alpha Targeting gRNAs

Figure 3:
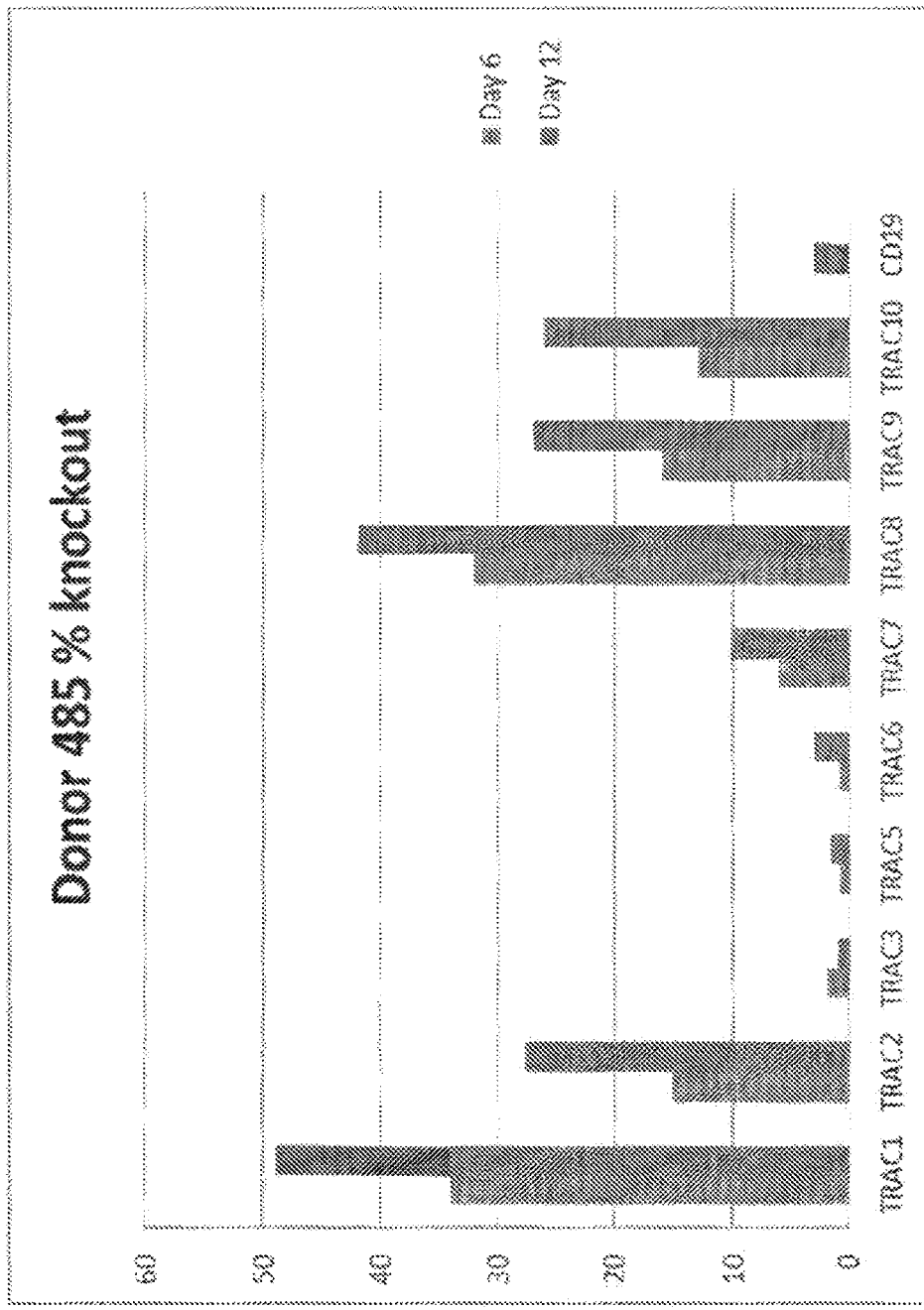
FIG. 3: Shown is the % TCR− primary T cells 6 and 12 days after introduction of lentivirus encoding the gRNA shown and Cas9/mCherry. Data represents % mCherry+ TCR− edited cells.

The procedure noted above was followed for assessing editing and loss of TCR in primary T cells, with the following modifications. 1E5 primary T cells were activated on Day 0 using 3:1 dyna beads anti-CD3/CD28 in 10 ul T cells media in a 96 well flat bottom plate. On Day 1 50 ul of lentivirus encoding gRNA and Cas9/mCherry (as described above) was added. T cells were cultured for 12 days by adding fresh media every 2 days to maintain a concentration of 5E5 cells/ml. Loss of TCR was measured as described above at day 6 and day 12 after lentivirus introduction. The results are shown in FIG. 3. These results demonstrate that TCR-alpha targeted gRNAs are able to cause loss of surface TCR expression in primary T cells.

Generation of PD1-Primary T Cells Using PDCD1 Targeting gRNAs

Figure 4:
FIG. 4: Shown is the % PD1-primary T cells in the mCherry+ gated population 3 days post restimulation (with CD3/CD28 beads) and 8 days post activation, in cells transfected with lentivirus encoding the gRNA indicated and Cas9/mCherry.

Editing of the PD-1 locus and loss of PD-1 expression was assessed as described above using lentiviral vectors encoding gRNA molecules to PD-1 listed in Table 10. Experiments were performed as described above for assessing TCR knockout in primary T cells, except that cells were restimulated with 3:1 dyna beads anti-CD3/CD28 in culture on Day 5 to drive increased expression of PD-1, enabling better detection of the protein. The results are reported in FIG. 4. These results demonstrate that gRNA molecules of the invention targeting PD-1 (PDCD1) lead to high efficiency loss of PD-1 expression in primary T cells.

Editing of PD-1 or TCR in Primary T Cells Using RNP

Figure 5A:
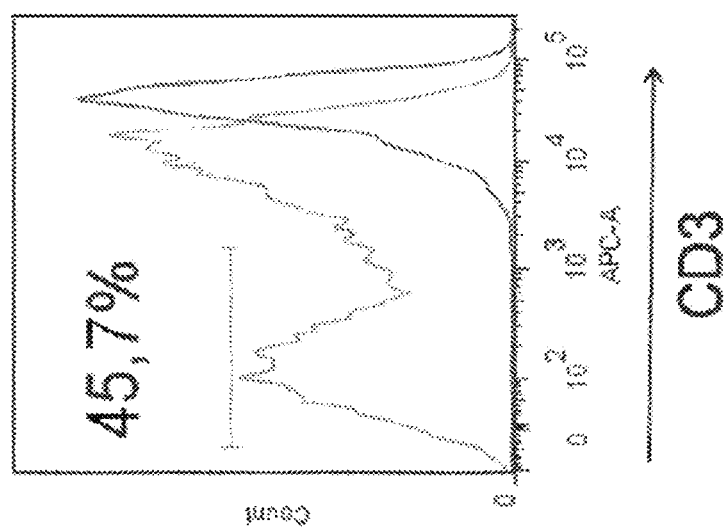
FIGS. 5A and 5B: Shown is expression of TCR on day 7 of culture using TRAC-8 gRNA (FIG. 5A) and PD-1 on day 8 of culture using PD1-6 gRNA (FIG. 5B) histograms.
Figure 5B:
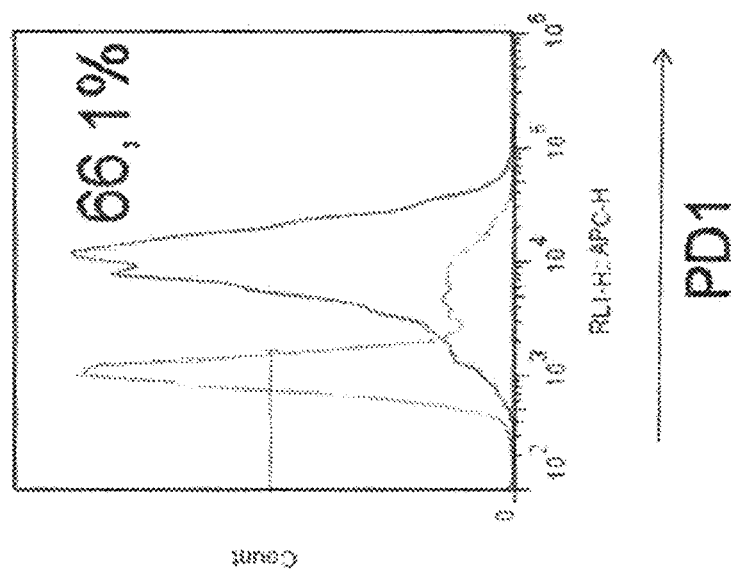

Editing of TCR or PD-1 in primary T cells was tested using Cas9/gRNA Ribonucleoprotein (RNP) complexes. RNPs were generated by mixing 20 ug of CAS9 (PNA bio) and 20 ug of chemically synthesized sgRNA (TriLink biotech) comprising either the targeting domain of TRAC-8 or of PD1-6, and incubating for 15 minutes at room temperature. T cells were isolated from Leukopak PBMCs using Pan T cell Isolation kit (Miltenyi) then activated with 3:1 CD3/CD28 dyna beads (invitrogen). 48 hours post activation, 2E5 T cells (without bead removal) were centrifuged at 300 g for 6 minutes and resuspended in 20 ul of Optimem and the RNP complex was added and mixed. Then the cells were transferred into a 1 mm electroporation cuvette (BTX) and pulsed using the BTX ECM 830 machine at 250V for 500 us and 1 pulse. The cells were returned into their T cell media and cultured for 5 days before analyses. FIG. 5 shows histograms of TCR or PD-1 expression as detected by flow cytometry after 7 days in culture. These results show that gRNAs targeting TCR alpha and PD-1 are effective at generating either TCR negative or PD1 negative T cells when introduced as RNP.

TCR Negative CAR T Cells

The ability of gRNA molecules targeting the TRAC locus to edit and lead to TCR negative phenotype in T cells engineered to express a chimeric antigen receptor (CAR) was determined. On Day 0 primary T cells were activated with 3:1 CD3/CD28 dyna beads at a concentration of 5E5 cells/ml in T cell media. On Day 1, T cells were engineered to express a CD19 CAR using lentiviral particles. T cells were engineered to express a CD19 CAR using lentiviral particles (lentivirus, as described in WO2012/079000) at MOI of 5–. On Day 2, T cells were electroporated with RNP comprising Cas9 protein and a gRNA molecule comprising the targeting domain of either TRAC-1 or TRAC-8. On Day 4 onwards, T cells were replenished with fresh media every 2 days to maintain a concentration of 5E5 cells/ml. On day 11 of T cell culture, the T cells were counted, and CD3 microbeads from Miltenyi biotech were added per manufacturer protocol. An LD magnetic column (Miltenyi) was used to perform the positive selection. As shown in FIG. 6, T cell populations which were ~40-50% TCR negative could be enriched to create isolated populations of TCRnegative CART cells at greater than 98% purity.

Activity of TCR Negative CART Cells

The T cells were cultured under standard culture conditions with the following modifications. On day 2 T cells were electroporated with RNP comprising gRNA targeting TCR alpha (TRAC-1 or TRAC-8) as described in "Editing of PD-1 or TCR in primary T cells using RNP," above, or were transduced with lentivirus encoding said gRNA and Cas9/mCherry, as described in Generation of TCR– primary T cells using TCR-alpha targeting gRNAs," above. On day 11 a purification of TCR– cells was added described in "TCR– CAR T cells," above. Isolated TCR negative cells were co-cultured with luciferase-expressing CD19+NALM6 (B-ALL cell) or CD19–K562 (CML cell) cells and the ability of the TCR-CART cells to specifically kill CD19+ cells was assessed. The results are shown in FIG. 7 (% cell lysis), and demonstrate that TCR negative CD19 CART cells comprising TCR-targeting gRNAs (by either lentiviral or RNP transfection) are capable of specifically killing CD19+ cells.

Example 4: B2M Excision Using Two gRNA Molecules

Figure 8:
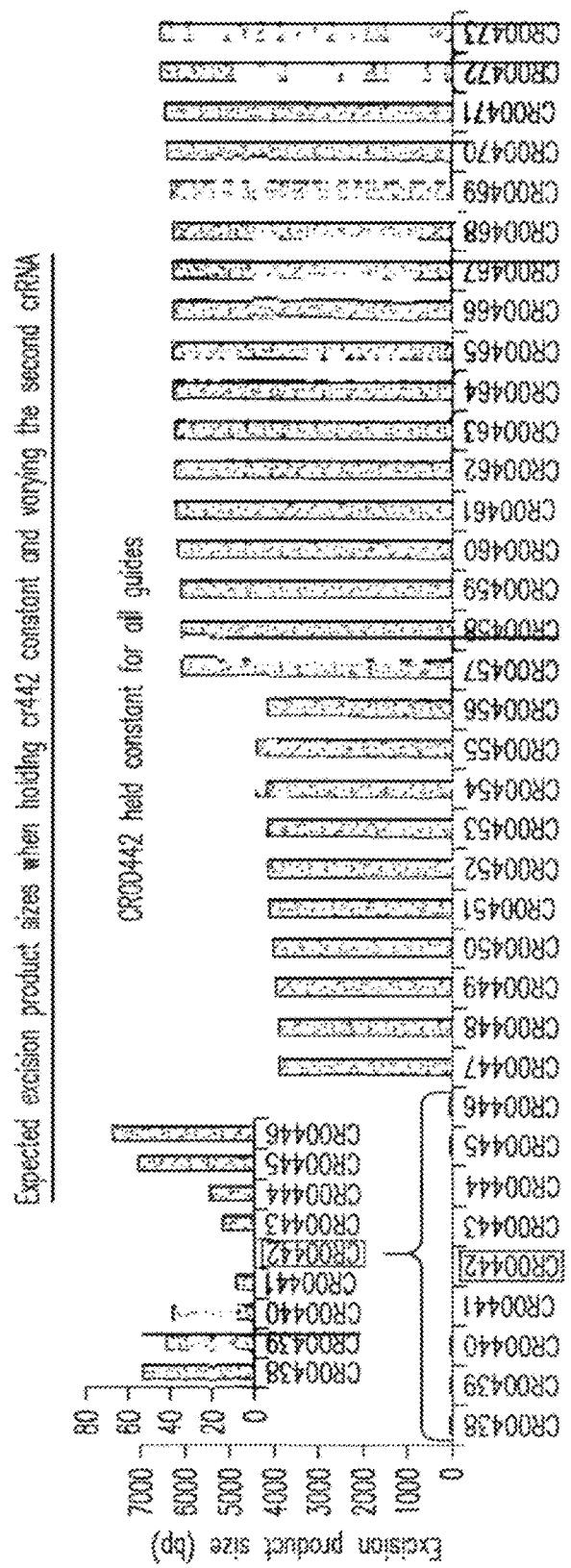
FIG. 8: Excision within the B2M gene employing CRISPR systems comprising two gRNA molecules. In each experiment, cells were exposed to gRNA with the targeting domain of CR00442 and a second gRNA molecule, as indicated. Shown is the predicted excision product size.
Figure 9:
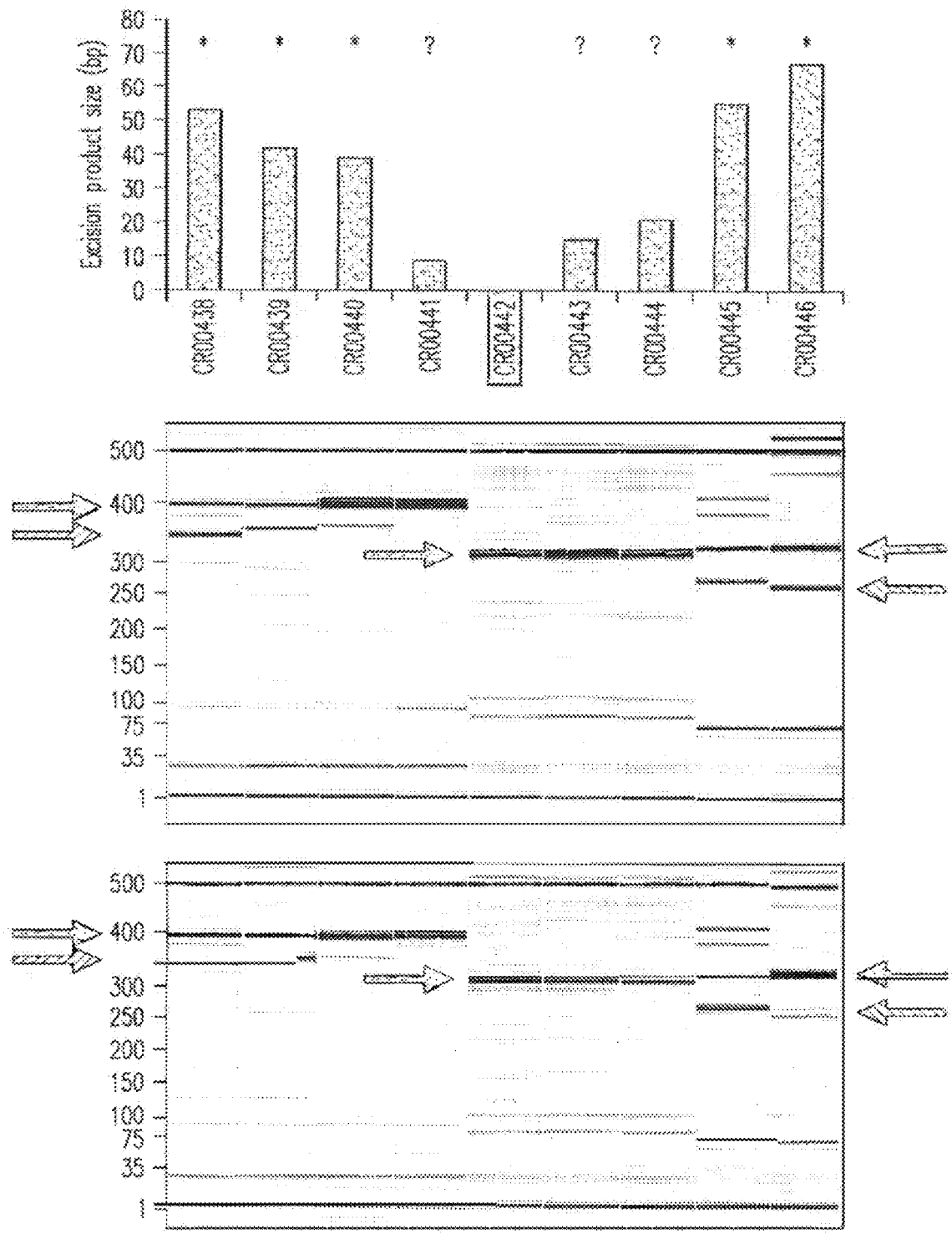
FIG. 9: Results of gRNA pair exposure to B2M gene with expected excision products of less than 100. * indicates expected excision product seen (green arrow); ?=expected excision product could not be resolved from the assay. Yellow arrow indicates wild type fragment.
Figure 10:
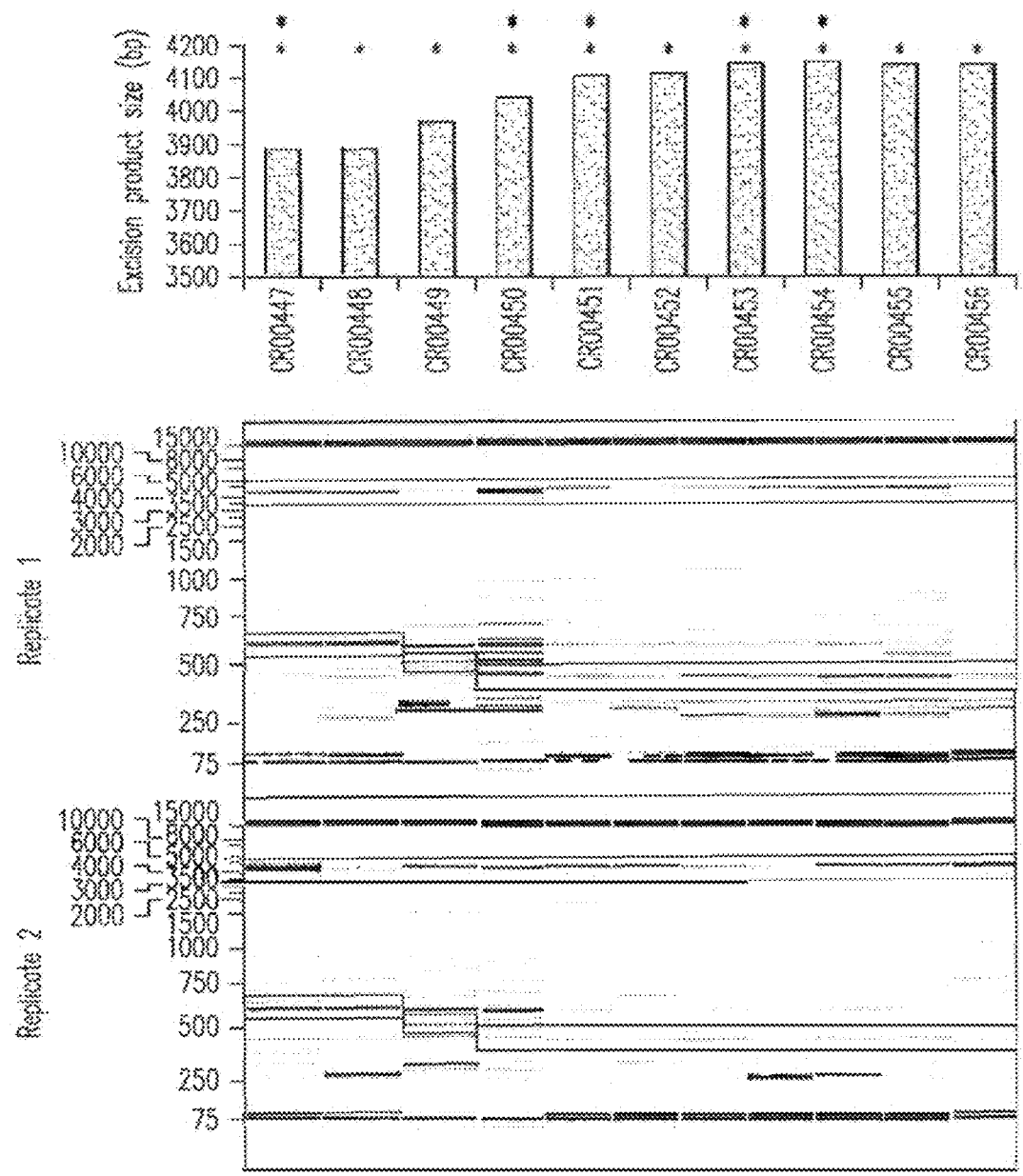
FIG. 10: Results of gRNA pair exposure to B2M gene with expected excision products ~4000 base pairs. Red * indicates expected excision product seen (green box); Purple *=less than 10% editing efficiency. Orange boxes indicate wild type fragment.
Figure 11:
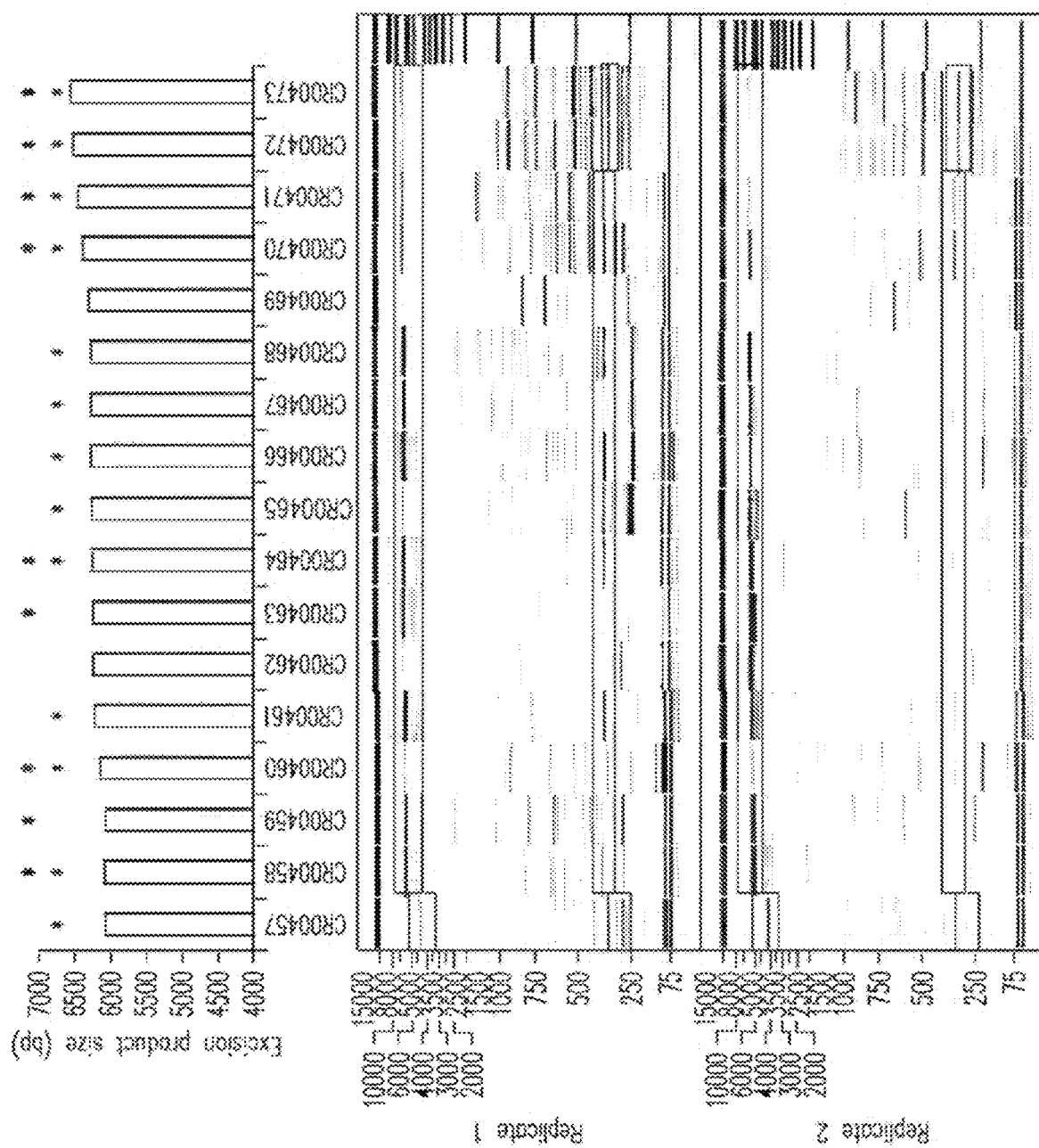
FIG. 11: Results of gRNA pair exposure to B2M gene with expected excision products ~6000 base pairs. Red * indicates expected excision product seen (green box); Purple *=less than 10% editing efficiency. Orange boxes indicate wild type fragment.

To test the ability of two gRNA molecules which bind to the same gene to excise large section of the target gene, we exposed cells to two gRNA molecules. In each experiment, CR00442 was used, in addition to a second gRNA molecule predicted to bind to a target site located from about 10 to about 6000 base pairs away from the binding site of CR00442. FIG. 8 shows the predicted excision product size based on the number of base pairs between the two gRNA molecule target sites. Experiments were performed as above, with crRNA molecules comprising the targeting domains of the indicated gRNA molecule (e.g., CR00442) and trRNA being transfected into HEK293 cells engineered to stably express Cas9. Cell lysates were collected at 24 hours and subjected to PCR. FIGS. 9-11 show the results of these experiments. As shown in FIG. 9, CR00442 paired with CR00438, CR00439, CR00440, CR00445 or CR00446 showed DNA fragments corresponding to the expected excision product, ranging from 40-65 base pairs. Pairs of gRNA molecules expected to yield excision products less than 20 base pairs did not result in a detectable excision product as measured by PCR. As shown in FIGS. 10 and 11, when the expected excision product is about 4000 base pairs (FIG. 10) or about 6000 base pairs (FIG. 11), many of the guide pairs produced the expected excision with >10% editing. These results demonstrate the feasibility of excising large portions of DNA from a host gene or genome through the use of two gRNA molecules, and offer an alternative approach to deactivate a gene or gene product.

Example 5: Editing of TRAC in HEK and Primary Human CD3+ Cells

Editing of CRISPR systems containing dgRNA molecules comprising targeting domains to sequences of TRAC were tested for editing in HEK (gRNA delivered to cells stably expressing Cas9) and in primary CD3+ T cells (gRNA/Cas9 RNP delivered by electroporation) according to the methods described herein.

As well, surface expression of TCR after editing was assayed by flow cytometry. Briefly, edited CD3+ cells were stained with antibodies against CD3 (OKT3, eBioscience) and/or TCR-alpha/beta (IP26 #, Biolegend) at day 3-5 post-electroporation. Expression of CD3 or TCR-alpha/beta in live cells (identified by propidium iodide exclusion) relative to the un-edited controls was used to determine frequency of RNP editing.

Figure 12:
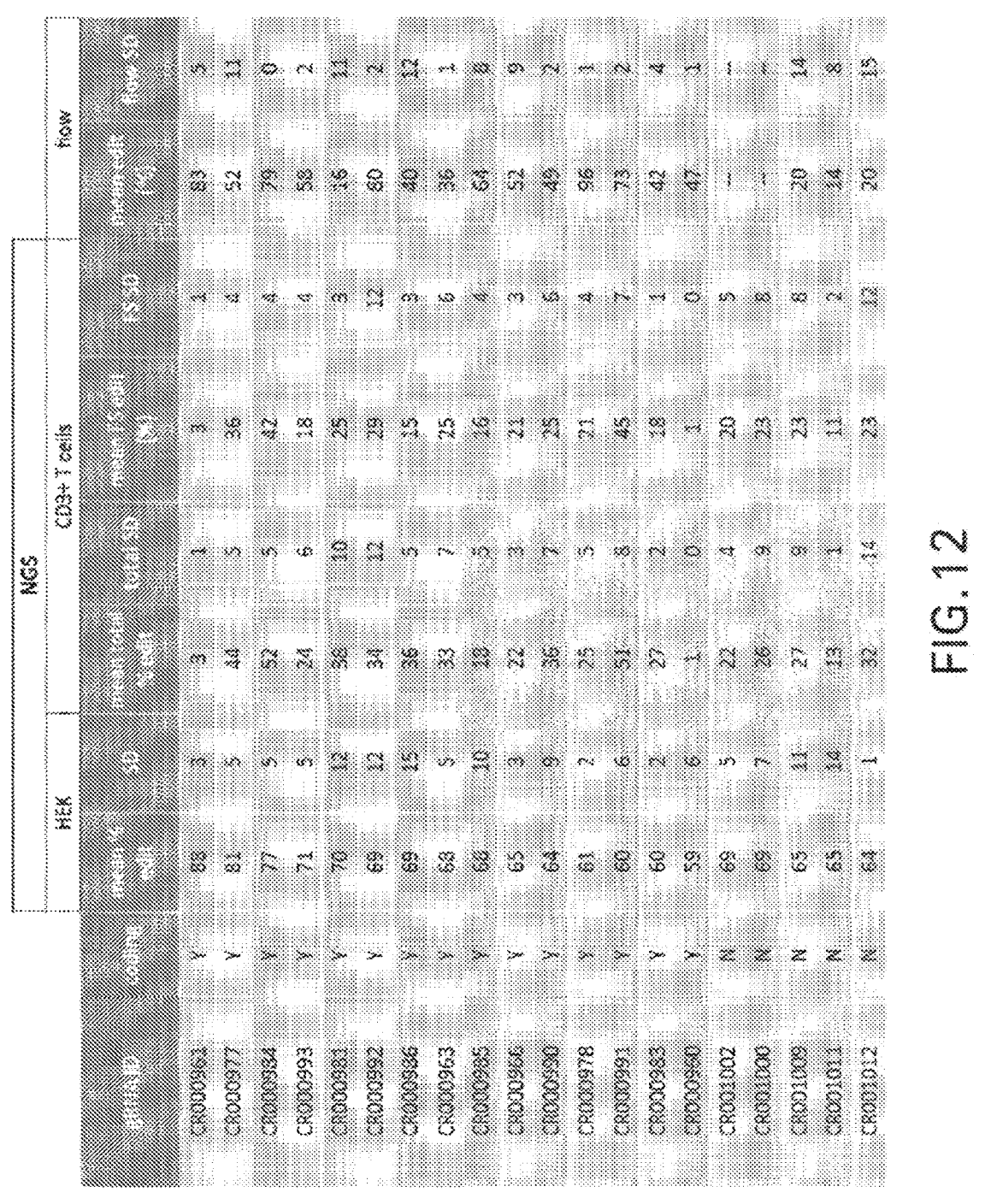

The results are reported in Table 11. All mean editing % are as measured by NGS and are based on at least 3 experiments. gRNA molecules are ranked by the % editing in HEK cells. FIG. 12 shows the top gRNA molecules to TRAC as ranked according to the % editing in HEK cells, together with the flow cytometry data showing the % editing in primary human CD3+ T cells as measured by loss of surface expression of TCR.

The indels formed after editing in CD3+ T cells were also assayed. The % of edited cells containing a frameshift mutation is shown in Table 11 ("mean FS edit %). As the TRAC locus results in an expressed protein, it is possible that 3 bp deletions or insertions may not result in disruption and degradation of TRAC. In contrast, frameshift mutations (1-2 bp in/dels) would cause the sequence subsequent to the edit to be out of frame and likely result in nonsense mediated degradation. Of note, there were often large differences in the editing % between the HEK and CD3+ T cells, namely the % editing in T cells was typically less than that observed in HEK cells. These differences were reproducible across multiple samples, including in Jurkat cells and different donor sources of primary T cells (not shown). Without being bound by theory, one explanation may be that the TCR locus undergoes rearrangement in T cells and Jurkat cells, but not in HEK cells. Indeed, NGS sequencing runs consistently failed or were of poor quality for the T cells or the Jurkat cells, regardless of donor, primers used or days post-editing that the cells were harvested for analysis (not shown). Thus, a more reliable measurement of % editing in primary T cells may be knockout at the protein level (e.g., loss of TCR by flow cytometry).

TABLE 11

| gRNA ID | Target | CD3+ (NGS) | | | | HEK (NGS) | |
|---|---|---|---|---|---|---|---|
| | | mean total % edit | SD | mean FS edit (%) | SD2 | mean % edit | SD |
| CR000961 | TRAC | 3.4 | 0.9 | 3.1 | 0.7 | 87.9 | 2.8 |
| CR000924 | TRAC | 37.4 | 6.1 | 30.9 | 5.5 | 87.3 | 2.9 |
| CR000948 | TRAC | 20.3 | 4.5 | 18.4 | 6.1 | 84.5 | 5.6 |
| CR000931 | TRAC | 37.7 | 11.4 | 34.9 | 9.3 | 83.6 | 7.6 |
| CR000929 | TRAC | 40.3 | 6.3 | 36.1 | 4.8 | 81.6 | 0.7 |
| CR000977 | TRAC | 44.2 | 4.5 | 35.7 | 4.4 | 80.6 | 4.8 |
| CR000944 | TRAC | 4.3 | 4.5 | 4.3 | 4.6 | 77.6 | 8.5 |
| CR000984 | TRAC | 52.1 | 4.6 | 42.1 | 4.2 | 77.0 | 5.3 |
| CR000933 | TRAC | 30.6 | 12.5 | 25.2 | 8.3 | 74.8 | 8.6 |
| CR000926 | TRAC | 22.5 | 9.2 | 19.9 | 6.9 | 73.0 | 4.5 |
| CR000943 | TRAC | 18.1 | 13.9 | 14.5 | 11.3 | 72.4 | 9.2 |
| CR000959 | TRAC | 2.4 | 0.4 | 2.1 | 0.2 | 71.9 | 4.1 |
| CR000993 | TRAC | 24.1 | 5.7 | 17.8 | 3.9 | 71.0 | 5.3 |
| CR000947 | TRAC | 7.2 | 3.3 | 6.5 | 2.8 | 70.7 | 9.5 |
| CR000981 | TRAC | 37.6 | 10.0 | 25.1 | 3.5 | 70.0 | 11.6 |
| CR000992 | TRAC | 33.7 | 12.0 | 29.1 | 12.0 | 69.2 | 12.4 |
| CR001002 | TRAC | 21.8 | 3.7 | 19.7 | 4.8 | 69.1 | 5.2 |
| CR001000 | TRAC | 26.2 | 9.5 | 22.7 | 7.6 | 68.9 | 7.4 |
| CR000927 | TRAC | 23.8 | 4.5 | 22.6 | 4.1 | 68.7 | 7.2 |
| CR000986 | TRAC | 36.4 | 5.1 | 14.8 | 3.0 | 68.6 | 14.9 |
| CR000963 | TRAC | 32.5 | 7.1 | 25.3 | 6.3 | 68.4 | 5.4 |
| CR000985 | TRAC | 17.7 | 5.4 | 16.3 | 4.4 | 68.1 | 10.0 |
| CR000923 | TRAC | 37.3 | 6.5 | 32.7 | 4.6 | 67.4 | 3.3 |
| CR000953 | TRAC | 17.7 | 2.1 | 14.4 | 1.1 | 66.0 | 12.8 |
| CR000946 | TRAC | 9.8 | 2.9 | 9.2 | 2.3 | 65.9 | 10.1 |
| CR000932 | TRAC | 9.9 | 3.3 | 7.9 | 4.1 | 65.7 | 7.8 |
| CR001009 | TRAC | 27.3 | 9.4 | 22.8 | 7.8 | 65.3 | 10.6 |
| CR000966 | TRAC | 22.0 | 2.9 | 21.0 | 2.6 | 65.2 | 2.7 |
| CR001011 | TRAC | 13.2 | 1.2 | 10.8 | 1.8 | 64.8 | 13.5 |
| CR001012 | TRAC | 31.5 | 14.2 | 22.9 | 12.0 | 64.5 | 1.4 |
| CR000990 | TRAC | 36.1 | 7.0 | 25.3 | 5.9 | 63.7 | 8.9 |
| CR000951 | TRAC | 6.7 | 3.0 | 6.0 | 3.5 | 63.5 | 16.5 |
| CR001001 | TRAC | 14.4 | 0.2 | 10.9 | 0.4 | 61.8 | 8.0 |
| CR000978 | TRAC | 24.7 | 5.1 | 20.8 | 4.4 | 60.7 | 2.3 |
| CR000934 | TRAC | 4.4 | 3.0 | 4.1 | 2.6 | 60.6 | 4.6 |
| CR000950 | TRAC | 7.5 | 0.8 | 5.4 | 0.4 | 60.4 | 9.2 |
| CR000920 | TRAC | 12.8 | 1.9 | 10.5 | 0.4 | 60.2 | 12.9 |
| CR000991 | TRAC | 51.2 | 8.1 | 45.4 | 6.9 | 60.1 | 6.4 |
| CR000956 | TRAC | 2.2 | 0.5 | 1.9 | 0.0 | 59.9 | 10.5 |
| CR000983 | TRAC | 26.6 | 2.0 | 18.2 | 0.7 | 59.8 | 1.8 |
| CR000936 | TRAC | NA | NA | NA | NA | 59.7 | 12.9 |
| CR000960 | TRAC | 1.2 | 0.1 | 1.2 | 0.2 | 59.4 | 6.5 |
| CR001007 | TRAC | 22.0 | 4.4 | 19.0 | 3.2 | 58.4 | 13.9 |
| CR000921 | TRAC | 12.7 | 2.0 | 11.3 | 1.1 | 58.3 | 9.1 |
| CR000952 | TRAC | 5.8 | 1.7 | 5.6 | 1.8 | 57.9 | 7.9 |
| CR000925 | TRAC | 19.1 | 4.3 | 12.3 | 5.1 | 56.9 | 6.1 |
| CR001006 | TRAC | 13.6 | 4.3 | 10.4 | 3.2 | 56.8 | 14.3 |
| CR000942 | TRAC | 9.8 | 6.4 | 9.8 | 6.3 | 56.8 | 1.6 |
| CR000938 | TRAC | 13.9 | 0.3 | 12.5 | 2.2 | 55.0 | 7.1 |
| CR000940 | TRAC | 22.1 | 4.7 | 14.4 | 4.1 | 55.0 | 10.4 |
| CR000989 | TRAC | 28.2 | 12.5 | 18.2 | 7.6 | 54.5 | 1.1 |
| CR000928 | TRAC | 18.1 | 1.8 | 14.6 | 0.4 | 54.2 | 22.1 |
| CR000935 | TRAC | NA | NA | NA | NA | 54.2 | 8.2 |
| CR001003 | TRAC | 13.6 | 4.6 | 10.1 | 4.3 | 53.5 | 9.5 |
| CR001014 | TRAC | 27.3 | 6.8 | 24.3 | 5.9 | 52.7 | 4.3 |
| CR000996 | TRAC | 11.1 | 0.7 | 8.6 | 0.2 | 52.3 | 7.3 |
| CR000967 | TRAC | 31.1 | 6.3 | 27.3 | 3.8 | 51.9 | 2.7 |
| CR000968 | TRAC | 26.1 | 4.1 | 24.1 | 4.2 | 51.6 | 10.5 |
| CR000964 | TRAC | 27.0 | 7.9 | 23.5 | 8.9 | 51.2 | 8.9 |
| CR000937 | TRAC | 15.8 | 3.4 | 10.8 | 2.0 | 50.9 | 6.6 |
| CR001005 | TRAC | 13.9 | 2.4 | 13.0 | 2.4 | 50.5 | 12.9 |
| CR001010 | TRAC | 21.2 | 4.4 | 18.6 | 3.2 | 48.3 | 7.0 |
| CR000982 | TRAC | 28.5 | 8.9 | 23.2 | 7.3 | 48.1 | 9.5 |
| CR001004 | TRAC | 6.7 | 2.8 | 6.4 | 2.5 | 47.2 | 15.3 |
| CR000994 | TRAC | 21.5 | 2.7 | 10.8 | 0.6 | 46.9 | 3.4 |
| CR000988 | TRAC | 22.3 | 4.7 | 17.4 | 3.5 | 41.9 | 5.4 |
| CR000973 | TRAC | 16.2 | 1.0 | 12.4 | 1.1 | 39.7 | 16.1 |
| CR000987 | TRAC | 20.6 | 1.8 | 18.2 | 2.2 | 39.6 | 4.0 |
| CR000922 | TRAC | 6.4 | 4.5 | 5.0 | 3.4 | 37.8 | 7.6 |
| CR001015 | TRAC | 21.8 | 0.2 | 20.4 | 0.0 | 35.9 | 17.5 |
| CR000969 | TRAC | 24.8 | 6.0 | 20.9 | 4.4 | 34.0 | 4.9 |
| CR000941 | TRAC | 9.6 | 4.5 | 7.6 | 4.1 | 33.4 | 3.9 |
| CR000945 | TRAC | 2.3 | 1.1 | 2.2 | 1.1 | 32.3 | 7.2 |
| CR000949 | TRAC | 2.5 | 2.0 | 2.5 | 1.9 | 30.2 | 6.2 |
| CR001013 | TRAC | 19.6 | 11.5 | 17.6 | 10.0 | 29.7 | 5.3 |
| CR000939 | TRAC | 13.5 | 3.1 | 12.1 | 2.2 | 27.7 | 5.2 |
| CR000995 | TRAC | 1.9 | 1.8 | 2.5 | 1.2 | 23.2 | 6.3 |
| CR000954 | TRAC | 2.7 | 0.4 | 2.6 | 0.3 | 22.3 | 6.7 |

TABLE 11-continued

| | | CD3 + (NGS) | | | | HEK (NGS) | |
|---|---|---|---|---|---|---|---|
| gRNA ID | Target | mean total % edit | SD | mean FS edit (%) | SD2 | mean % edit | SD |
| CR000962 | TRAC | 10.4 | 1.3 | 8.6 | 1.2 | 21.3 | 5.0 |
| CR000958 | TRAC | 1.0 | 0.3 | 1.0 | 0.3 | 20.4 | 4.4 |
| CR000972 | TRAC | 6.9 | 2.5 | 6.4 | 2.3 | 16.2 | 4.9 |
| CR001008 | TRAC | 5.1 | 1.1 | 4.5 | 0.9 | 13.6 | 1.7 |
| CR000970 | TRAC | 10.9 | 2.3 | 9.3 | 2.8 | 13.4 | 4.7 |
| CR000999 | TRAC | 12.0 | 2.4 | 11.4 | 2.1 | 13.1 | 17.9 |
| CR000930 | TRAC | 9.9 | 0.6 | 7.1 | 3.2 | 12.2 | 1.6 |
| CR000997 | TRAC | 6.7 | 0.8 | 6.4 | 0.8 | 11.6 | 4.7 |
| CR000955 | TRAC | 2.7 | 0.7 | 2.7 | 0.7 | 10.0 | 1.5 |
| CR000975 | TRAC | 3.8 | 2.0 | 3.1 | 1.4 | 8.0 | 0.8 |
| CR000998 | TRAC | 2.4 | 0.6 | 2.2 | 0.8 | 4.3 | 1.3 |
| CR000974 | TRAC | 1.9 | 0.5 | 1.8 | 0.6 | 3.3 | 0.8 |
| CR000971 | TRAC | 3.0 | 1.0 | 2.4 | 0.5 | 3.1 | 0.6 |
| CR000979 | TRAC | 2.2 | 1.0 | 2.2 | 1.0 | 3.0 | 0.4 |
| CR000976 | TRAC | 1.8 | 0.6 | 1.7 | 0.6 | 2.8 | 0.1 |
| CR000957 | TRAC | 1.3 | 0.0 | 1.3 | 0.0 | 1.6 | 0.4 |
| CR000965 | TRAC | 1.0 | 0.1 | 1.0 | 0.1 | 1.4 | 0.1 |
| CR000980 | TRAC | 33.0 | 5.0 | 26.1 | 3.7 | N/A | N/A |

Figure 15:
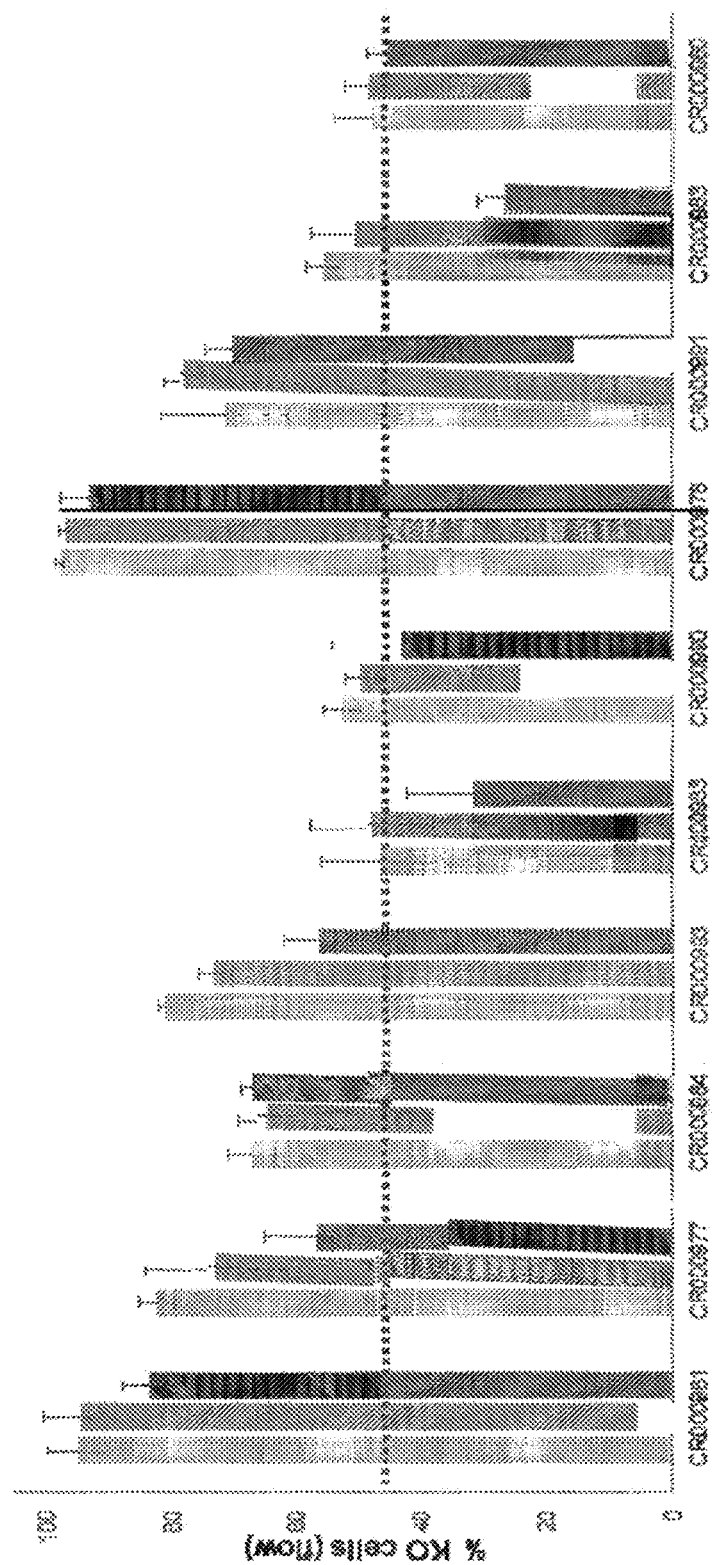
FIG. 15: Editing as measured by loss of TCR (flow cytometry) of CRISPR systems comprising the indicated gRNA molecule in primary human CD3+ T cells from three different donors. For each gRNA, left bar=donor #1; middle bar=donor #2; right bar=donor #3.

Editing in primary human T cells with systems comprising gRNAs targeting TRAC were next tested in primary human CD3+ T cells from 3 different donors. As shown in FIG. 15, % editing (as determined by loss of TCR by flow cytometry) was consistent across all donors. These data demonstrated that certain gRNA molecules, in combination with Cas9, were capable of creating indels within the TCR-alpha sub-unit that result in loss of TCR expression on the surface of T cells. The editing efficiency is donor independent thus showing the broad applicability of this approach.

Example 6: Editing of TRBC1 and TRBC2 in HEK Cells

Figure 13:
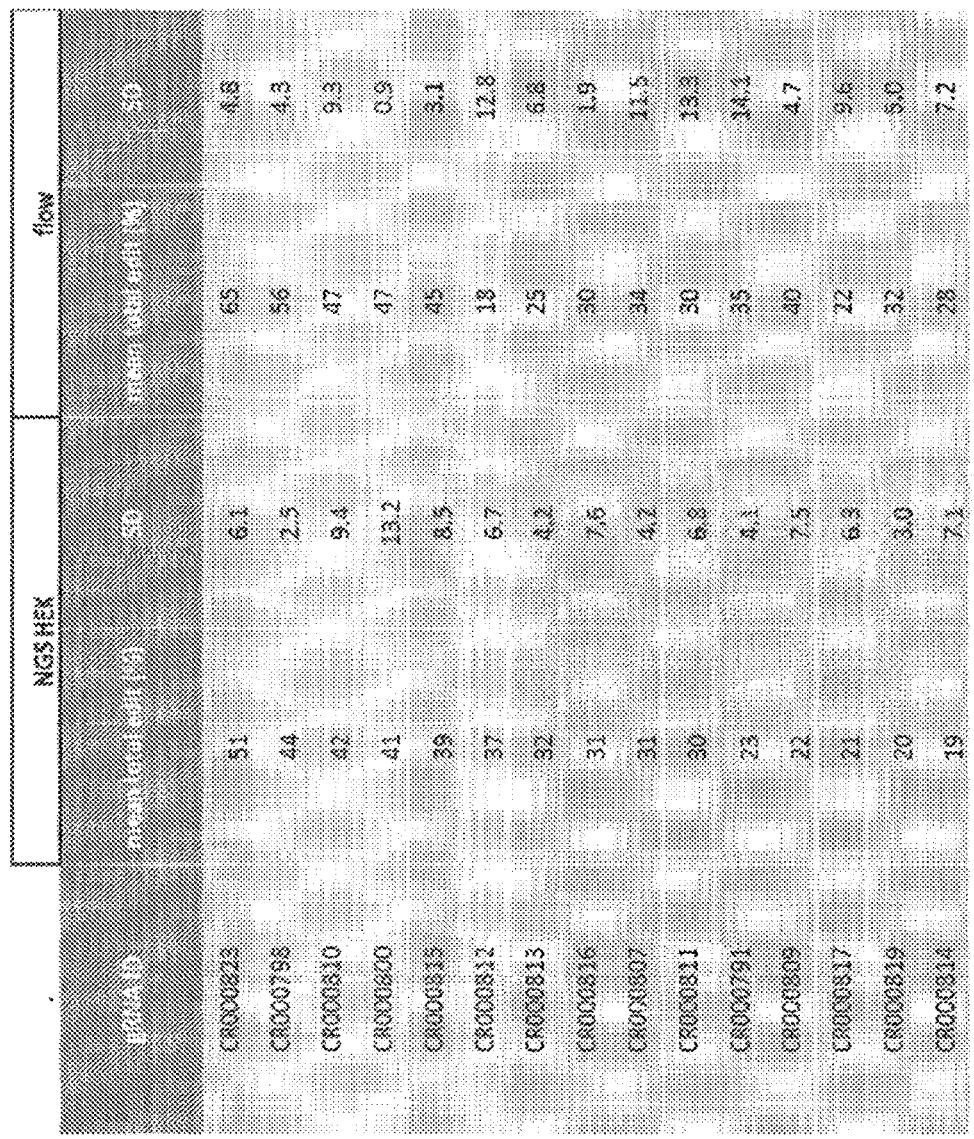
FIG. 13: Mean (n≥3) editing of CRISPR systems with dgRNAs as indicated to coding regions of TRBC1 and TRBC2 in HEK cells (stably expressing Cas9). Also shown is % of T cells exhibiting loss of TCR as determined by flow cytometry using an anti-TCR a/b antibody.

Editing of CRISPR systems containing dgRNA molecules comprising targeting domains to sequences of TRBC1 and TRBC2 were tested for editing in HEK (gRNA delivered to cells stably expressing Cas9) and CD3+ T cells (gRNA and Cas9 delivered as RNP) according to the methods described herein. The results are reported in Table 12. All mean editing % are as measured by NGS and are based on at least 3 experiments. FIG. 13 shows the top gRNA molecules to TRBC1 and TRBC2 as ranked according to the % editing in HEK cells, together with the flow cytometry data showing the % editing in primary human CD3+ T cells as measured by loss of surface expression of TCR.

TABLE 12

| | | | HEK (NGS) | |
|---|---|---|---|---|
| gRNA ID | Target | Coding vs non-coding targeted region | mean total % edit | SD |
| CR000789 | TRBC2 | Non-coding | 62% | 3% |
| CR000780 | TRBC2 | Non-coding | 60% | 9% |
| CR000734 | TRBC1 | Non-coding | 59% | 6% |
| CR000761 | TRBC2 | Non-coding | 57% | 2% |
| CR000776 | TRBC2 | Non-coding | 54% | 9% |
| CR000786 | TRBC2 | Non-coding | 53% | 7% |
| CR000785 | TRBC2 | Non-coding | 52% | 4% |
| CR000737 | TRBC1 | Non-coding | 52% | 5% |
| CR000775 | TRBC2 | Non-coding | 51% | 5% |
| CR000783 | TRBC2 | Non-coding | 51% | 5% |
| CR000823 | TRBC2 | Coding | 51% | 6% |
| CR000756 | TRBC2 | Non-coding | 45% | 2% |
| CR000798 | TRBC2 | Non-coding | 44% | 2% |
| CR000735 | TRBC1 | Non-coding | 44% | 7% |
| CR000731 | TRBC1 | Non-coding | 44% | 5% |
| CR000729 | TRBC1 | Non-coding | 43% | 4% |
| CR000774 | TRBC2 | Non-coding | 43% | 5% |
| CR000810 | TRBC2 | Coding | 42% | 9% |
| CR000800 | TRBC2 | Coding | 41% | 13% |
| CR000784 | TRBC2 | Non-coding | 40% | 3% |
| CR000762 | TRBC2 | Non-coding | 40% | 5% |
| CR000782 | TRBC2 | Non-coding | 40% | 4% |
| CR000815 | TRBC2 | Coding | 39% | 9% |
| CR000748 | TRBC2 | Non-coding | 39% | 3% |
| CR000760 | TRBC2 | Non-coding | 38% | 3% |
| CR000781 | TRBC2 | Non-coding | 37% | 4% |
| CR000812 | TRBC2 | Coding | 37% | 7% |
| CR000732 | TRBC1 | Non-coding | 36% | 5% |
| CR000788 | TRBC2 | Coding | 36% | 7% |
| CR000752 | TRBC2 | Non-coding | 36% | 13% |
| CR000745 | TRBC1 | Non-coding | 34% | 4% |
| CR000759 | TRBC2 | Non-coding | 33% | 7% |
| CR000813 | TRBC2 | Coding | 32% | 4% |
| CR000770 | TRBC2 | Non-coding | 32% | 7% |
| CR000738 | TRBC1 | Coding | 31% | 5% |
| CR000816 | TRBC2 | Coding | 31% | 8% |
| CR000744 | TRBC1 | Non-coding | 31% | 2% |
| CR000807 | TRBC2 | Coding | 31% | 4% |
| CR000811 | TRBC2 | Coding | 30% | 7% |
| CR000766 | TRBC2 | Non-coding | 30% | 2% |
| CR000787 | TRBC2 | Non-coding | 30% | 1% |
| CR000751 | TRBC2 | Non-coding | 30% | 6% |
| CR000730 | TRBC1 | Non-coding | 29% | 3% |
| CR000739 | TRBC1 | Non-coding | 28% | 6% |
| CR000768 | TRBC2 | Non-coding | 28% | 2% |
| CR000771 | TRBC2 | Non-coding | 27% | 4% |
| CR000763 | TRBC2 | Non-coding | 26% | 4% |
| CR000754 | TRBC2 | Non-coding | 26% | 7% |
| CR000755 | TRBC2 | Non-coding | 24% | 4% |
| CR000769 | TRBC2 | Non-coding | 24% | 1% |
| CR000777 | TRBC2 | Non-coding | 23% | 1% |
| CR000764 | TRBC2 | Non-coding | 23% | 6% |
| CR000749 | TRBC2 | Non-coding | 23% | 5% |
| CR000767 | TRBC2 | Non-coding | 23% | 5% |
| CR000791 | TRBC2 | Non-coding | 23% | 4% |
| CR000809 | TRBC2 | Coding | 22% | 8% |
| CR000773 | TRBC2 | Non-coding | 22% | 7% |
| CR000817 | TRBC2 | Coding | 21% | 6% |
| CR000746 | TRBC1 | Non-coding | 21% | 4% |
| CR000753 | TRBC2 | Non-coding | 21% | 1% |
| CR000757 | TRBC2 | Non-coding | 21% | 1% |
| CR000793 | TRBC2 | Non-coding | 21% | 4% |
| CR000743 | TRBC1 | Non-coding | 20% | 4% |
| CR000741 | TRBC1 | Non-coding | 20% | 2% |
| CR000819 | TRBC2 | | 20% | 3% |
| CR000740 | TRBC1 | Non-coding | 19% | 2% |
| CR000814 | TRBC2 | Coding | 19% | 7% |
| CR000728 | TRBC1 | Non-coding | 16% | 6% |
| CR000742 | TRBC1 | Non-coding | 14% | 3% |
| CR000733 | TRBC1 | Non-coding | 10% | 4% |
| CR000747 | TRBC1 | Non-coding | 8% | 1% |
| CR000736 | TRBC1 | Non-coding | 8% | 1% |

These data demonstrated that certain gRNA molecules, in combination with Cas9, were capable of creating indels within the TCR-beta sub-unit that result in loss of TCR expression on the surface of T cells.

Example 7: Editing of PDCD1 in HEK Cells and Primary Human CD3+ T Cells

Editing of CRISPR systems containing dgRNA molecules comprising targeting domains to sequences of PDCD1 were tested for editing in HEK (gRNA delivered to cells stably expressing Cas9) and CD3+ T cells (gRNA and Cas9 delivered as RNP) according to the methods described herein.

Figure 16:
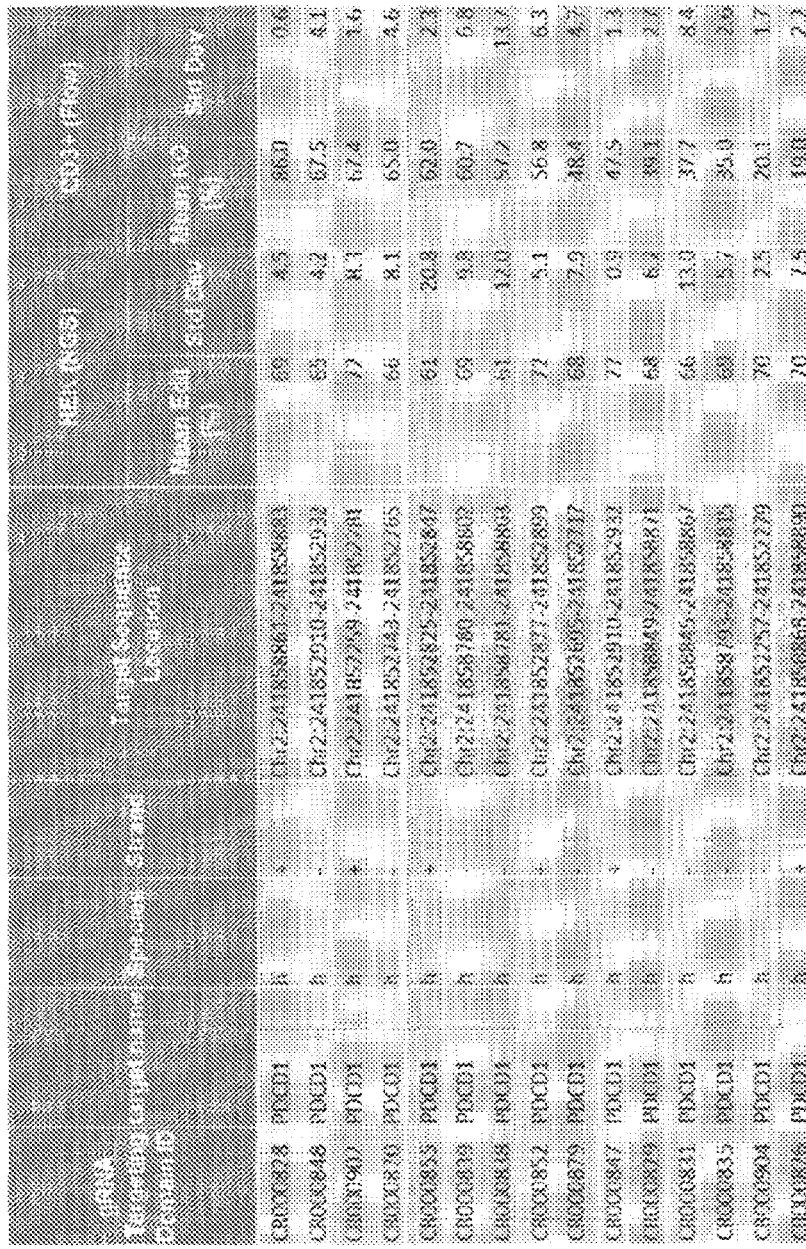
FIG. 16: Mean (n≥3) editing of CRISPR systems with dgRNAs as indicated to PDCD1 in HEK cells (stably expressing Cas9) as measured by NGS, and in primary human CD3+ cells (RNP electroporation) as measured by loss of PD-1 (flow cytometry using anti-PD-1 antibody).
Figure 17A:
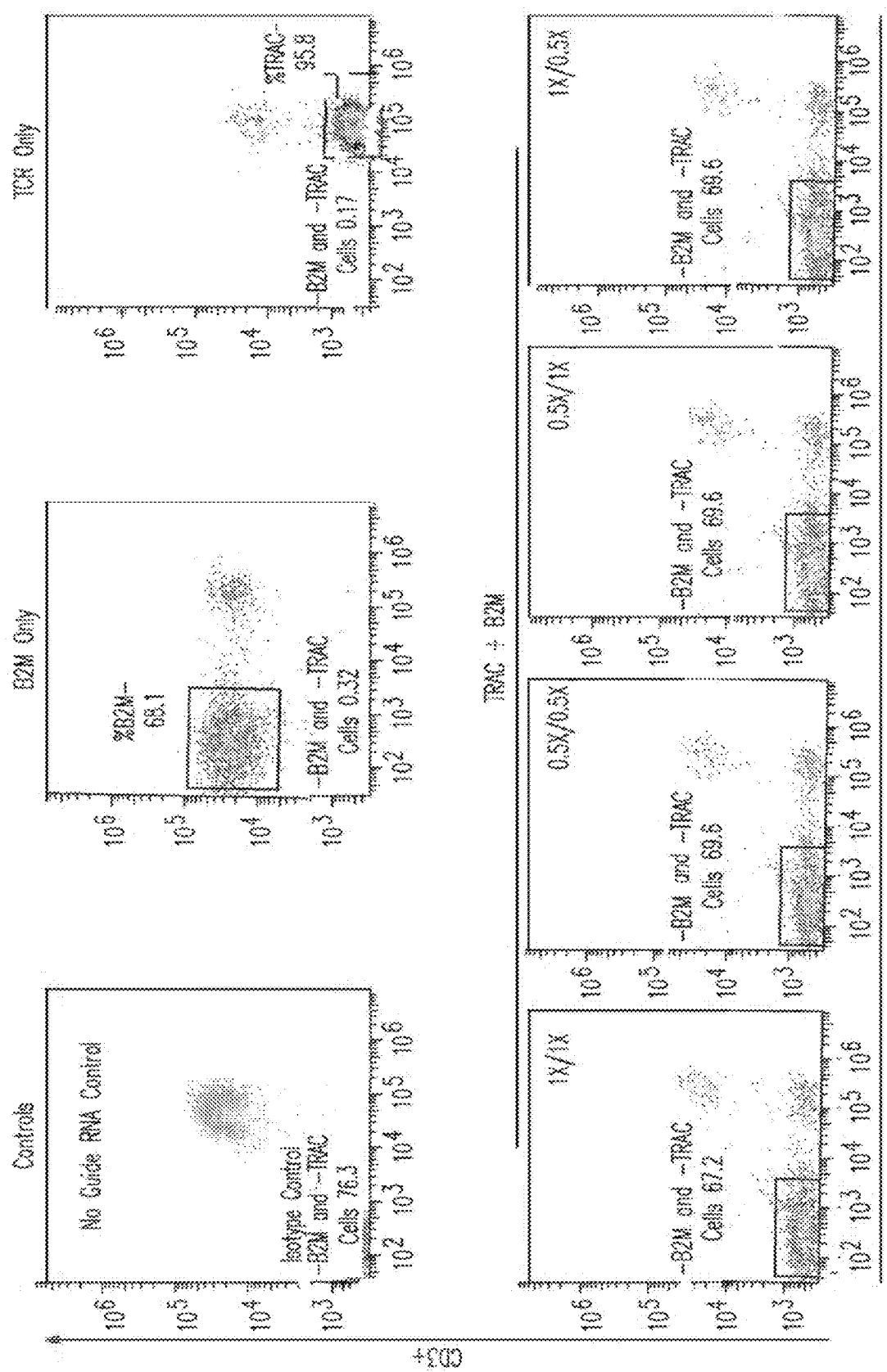
FIG. 17A: Flow Cytometry expression of TCR and/or B2M after electroporation of gRNA to TRAC and/or B2M at the indicated ratios.
Figure 17C:
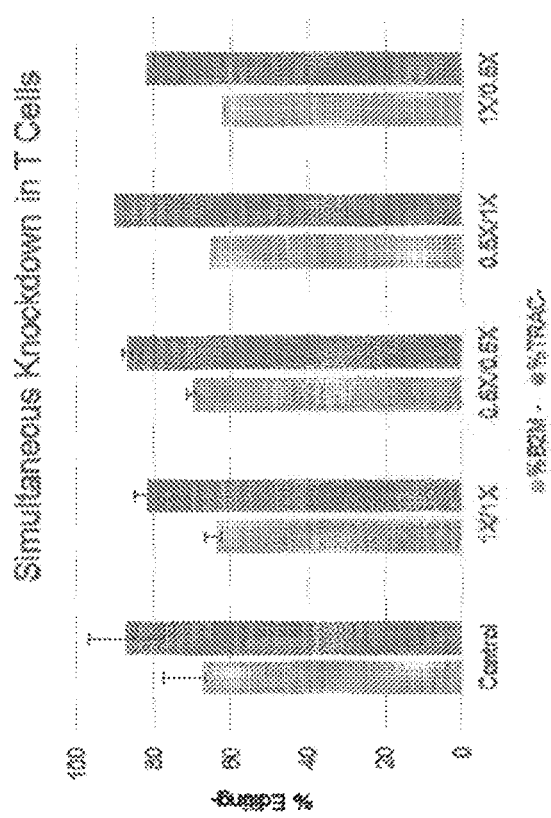
FIG. 17C: editing of either B2M or TCR as measured by flow cytometry.
Figure 17D:
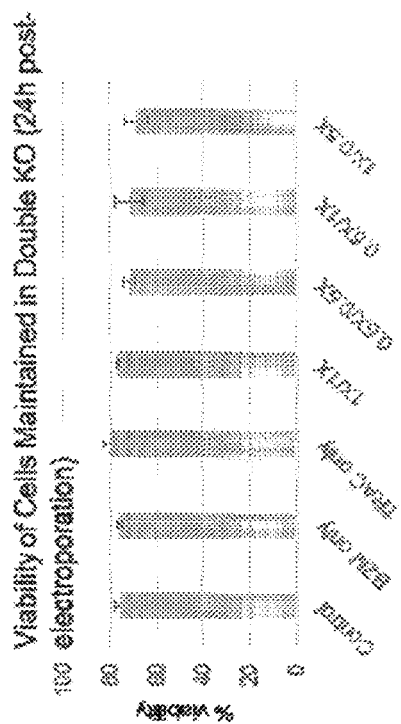
FIG. 17D: Viability of cells 24 hours after electroporation.

The results of editing in HEK cells are reported in Table 13. All mean editing % are as measured by NGS and are based on at least 3 experiments. FIG. 16 shows the top gRNA molecules to PDCD1 as ranked according to the % editing in HEK cells. FIG. 16 also shows % of cells with loss of PD-1 expression as measured by flow cytometry using an anti-PD-1 antibody (ceBioJ105, eBioscience). Briefly, primary human CD3+ T cells were activated with StemCell ImmunoCult beginning on day 0. RNP containing the indicated dgRNA were electroporated into the cells on day 3 (Neon; 1600 V, 10 ms, 3 pulses). 2 days after transfection (day 5), cells were stimulated with antiCD3/CD28 Dynabeads (1:3 cell:bead ratio). PD-1 expression was assessed on day 10.

TABLE 13

| gRNA ID | target name | HEK (NGS) % Editing Mean | Std Dev |
|---|---|---|---|
| CR000847 | PDCD1 | 77% | 1% |
| CR000902 | PDCD1 | 72% | 8% |
| CR000852 | PDCD1 | 72% | 5% |
| CR000826 | PDCD1 | 70% | 7% |
| CR000904 | PDCD1 | 70% | 2% |
| CR000839 | PDCD1 | 69% | 10% |
| CR000828 | PDCD1 | 69% | 4% |
| CR000835 | PDCD1 | 69% | 6% |
| CR000829 | PDCD1 | 68% | 6% |
| CR000879 | PDCD1 | 68% | 8% |
| CR000870 | PDCD1 | 66% | 8% |
| CR000831 | PDCD1 | 66% | 13% |
| CR000848 | PDCD1 | 65% | 4% |
| CR000855 | PDCD1 | 61% | 21% |
| CR000838 | PDCD1 | 61% | 12% |
| CR000840 | PDCD1 | 59% | 5% |
| CR000884 | PDCD1 | 59% | 7% |
| CR000830 | PDCD1 | 57% | 12% |
| CR000871 | PDCD1 | 57% | 8% |
| CR000850 | PDCD1 | 55% | 9% |
| CR000869 | PDCD1 | 55% | 6% |
| CR000903 | PDCD1 | 54% | 8% |
| CR000824 | PDCD1 | 54% | 7% |
| CR000882 | PDCD1 | 50% | 11% |
| CR000918 | PDCD1 | 50% | 9% |
| CR000895 | PDCD1 | 49% | 10% |
| CR000832 | PDCD1 | 49% | 8% |
| CR000874 | PDCD1 | 47% | 5% |
| CR000868 | PDCD1 | 47% | 7% |
| CR000846 | PDCD1 | 46% | 6% |
| CR000887 | PDCD1 | 46% | 6% |
| CR000825 | PDCD1 | 46% | 6% |
| CR000892 | PDCD1 | 45% | 11% |
| CR000917 | PDCD1 | 43% | 9% |
| CR000896 | PDCD1 | 42% | 7% |
| CR000919 | PDCD1 | 42% | 8% |
| CR000863 | PDCD1 | 40% | 9% |
| CR000842 | PDCD1 | 40% | 15% |
| CR000827 | PDCD1 | 39% | 11% |
| CR000837 | PDCD1 | 36% | 8% |
| CR000915 | PDCD1 | 35% | 10% |
| CR000833 | PDCD1 | 34% | 5% |
| CR000853 | PDCD1 | 33% | 4% |
| CR000891 | PDCD1 | 29% | 11% |
| CR000849 | PDCD1 | 29% | 7% |
| CR000897 | PDCD1 | 26% | 2% |
| CR000872 | PDCD1 | 26% | 5% |
| CR000844 | PDCD1 | 25% | 3% |
| CR000854 | PDCD1 | 24% | 6% |
| CR000867 | PDCD1 | 24% | 4% |
| CR000856 | PDCD1 | 23% | 4% |
| CR000845 | PDCD1 | 21% | 6% |
| CR000881 | PDCD1 | 21% | 3% |

TABLE 13-continued

| gRNA ID | target name | HEK (NGS) % Editing Mean | Std Dev |
|---|---|---|---|
| CR000894 | PDCD1 | 19% | 3% |
| CR000834 | PDCD1 | 19% | 7% |
| CR000841 | PDCD1 | 19% | 1% |
| CR000858 | PDCD1 | 16% | 2% |
| CR000859 | PDCD1 | 12% | 3% |
| CR000898 | PDCD1 | 11% | 3% |
| CR000880 | PDCD1 | 10% | 2% |
| CR000893 | PDCD1 | 10% | 1% |
| CR000885 | PDCD1 | 10% | 1% |
| CR000883 | PDCD1 | 9% | 1% |
| CR000843 | PDCD1 | 8% | 2% |
| CR000864 | PDCD1 | 7% | 1% |
| CR000875 | PDCD1 | 6% | 2% |
| CR000899 | PDCD1 | 5% | 3% |
| CR000890 | PDCD1 | 5% | 2% |
| CR000914 | PDCD1 | 5% | 1% |
| CR000836 | PDCD1 | 5% | 1% |
| CR000916 | PDCD1 | 5% | 1% |
| CR000877 | PDCD1 | 5% | 1% |
| CR000888 | PDCD1 | 4% | 1% |
| CR000866 | PDCD1 | 4% | 1% |
| CR000851 | PDCD1 | 4% | 0% |
| CR000865 | PDCD1 | 4% | 1% |
| CR000889 | PDCD1 | 3% | 0% |
| CR000876 | PDCD1 | 3% | 0% |
| CR000886 | PDCD1 | 2% | 0% |
| CR000857 | PDCD1 | 1% | 0% |
| CR000878 | PDCD1 | 1% | 0% |
| CR000860 | PDCD1 | NA | NA |
| CR000861 | PDCD1 | NA | NA |
| CR000862 | PDCD1 | NA | NA |
| CR000873 | PDCD1 | NA | NA |
| CR000900 | PDCD1 | NA | NA |
| CR000901 | PDCD1 | NA | NA |
| CR000905 | PDCD1 | NA | NA |
| CR000906 | PDCD1 | NA | NA |
| CR000907 | PDCD1 | NA | NA |
| CR000908 | PDCD1 | NA | NA |
| CR000909 | PDCD1 | NA | NA |
| CR000910 | PDCD1 | NA | NA |
| CR000911 | PDCD1 | NA | NA |
| CR000912 | PDCD1 | NA | NA |
| CR000913 | PDCD1 | NA | NA |

Figure 18:
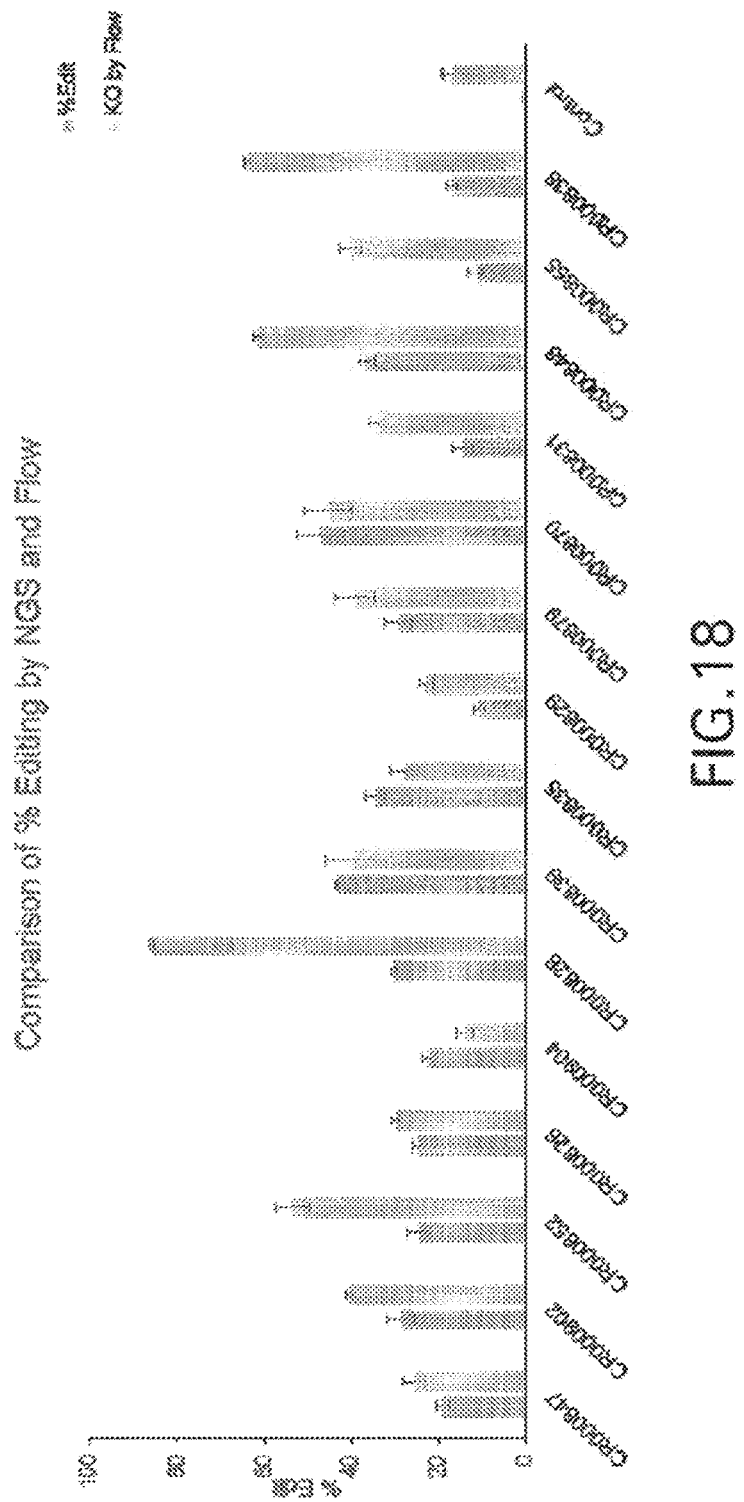
FIG. 18: % Editing using dgRNAs containing targeting domains to PDCD1 (the targeting domain of the CRxxxx sequence indicated) in primary CD3+ T cells as measured by NGS (yellow bars) or loss of PD-1 by flow cytometry (using anti-PD-1 antibody). NGS sequencing was performed 24 hours post-RNP delivery; flow cytometry performed at day 5 post-RNP delivery.
Figure 19:
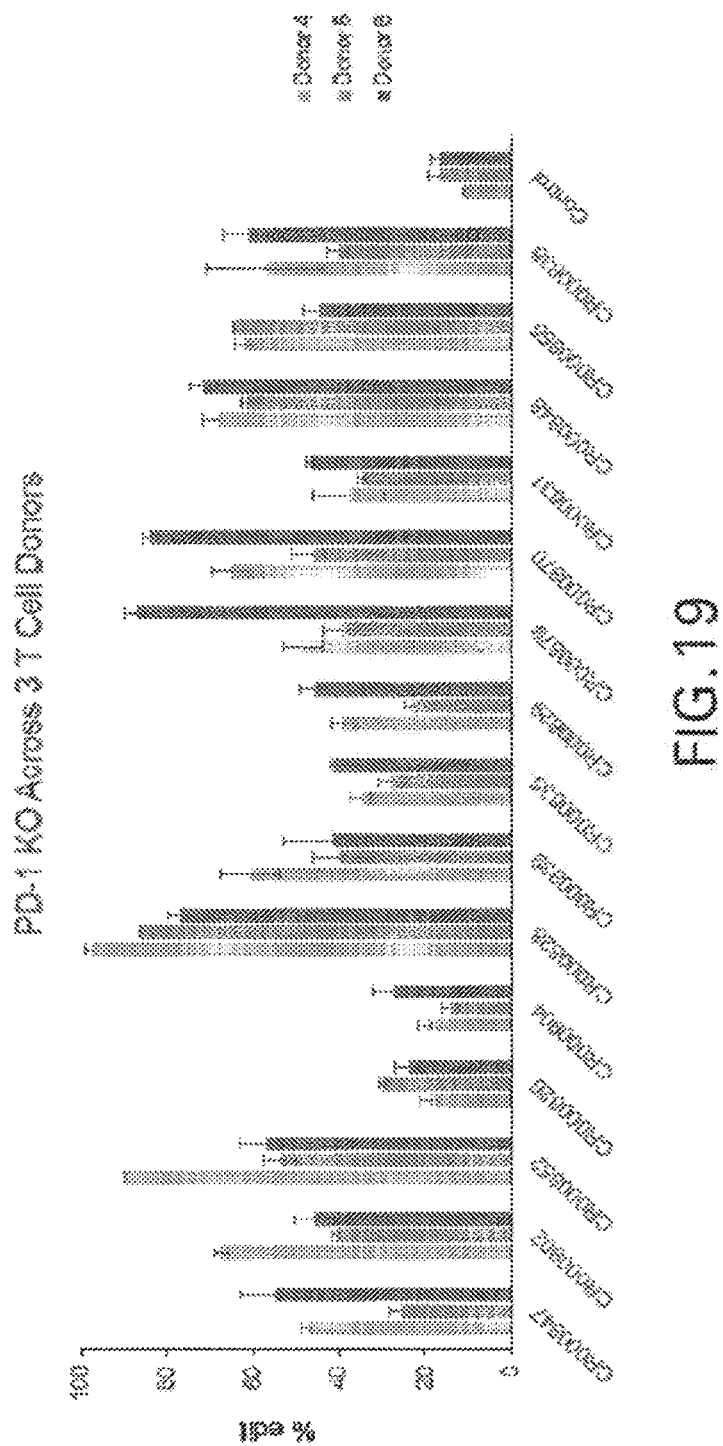
FIG. 19: % Editing (n>=3) using dgRNAs containing targeting domains to PDCD1 (the targeting domain of the CRxxxx sequence indicated) in primary CD3+ T cells as measured by loss of PD-1 by flow cytometry (using anti-PD-1 antibody) across three different donors (donor #4, left-most bar; donor $5, middle bar; donor #6, right-most bar). Systems with targeting domains to some targets show >50% loss of PD-1, with consistent results across multiple donors. gRNAs including the targeting domain of CR00852, CR00828, CR00870, CR00848, CR00855 and CR00838 show greater than 50% editing across at least 2 donors.
Figure 20:
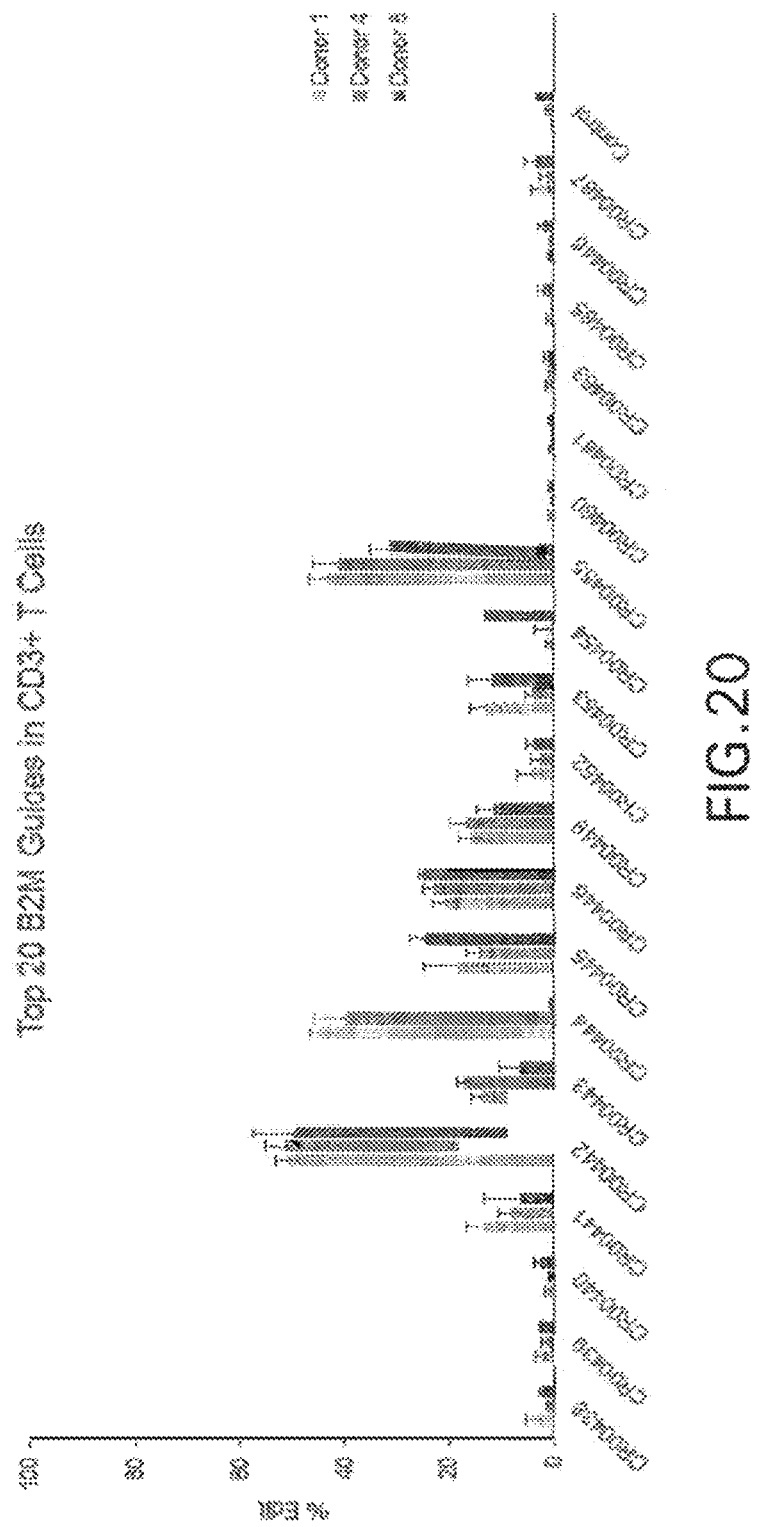
FIG. 20: % Editing (n>=3) using dgRNAs containing targeting domains to B2M (the targeting domain of the CRxxxx sequence indicated) in primary CD3+ T cells as measured by loss of B2M by flow cytometry across three different donors (donor #1, left-most bar; donor #4, middle bar; donor #5, right-most bar). Systems with targeting domains to some target sequences show >40% loss of B2M, with consistent results across multiple donors. gRNAs including the targeting domain of CR00442, CR00444 and CR00455 show greater than 40% editing across at least 2 donors.

Next, editing of PDCD1 by RNPs comprising dgRNA molecules that include the targeting domain of the indicated CRxxxx ID was assayed in primary human CD3+ T cells as measured by NGS, and loss of PD-1 surface expression was assayed by flow cytometry, as described herein. The results are reported at FIG. 18. Several gRNA molecules show good editing and loss of PD-1. These same guides were then tested in CD3+ T cells from three different donors. The data is reported at FIG. 19. As shown, gRNAs including the targeting domain of CR00852, CR00828, CR00870, CR00848, CR00855 and CR00838 show greater than 50% editing across at least 2 donors.

Example 8: Simultaneous and Sequential Knockout of TRAC and B2M in Primary Human CD3+ T Cells Primary human CD3+ T cells were activated and electroporated with RNP containing gRNA to B2M (CR000442) and/or TRAC (CR000984). Briefly, RNPs targeting B2M and/or TRAC were electroporated into CD3+ T cells in the following ratios: B2M RNP only; TRAC RNP only; B2M RNP+TRAC RNP; B2M RNP+0.5×TRAC RNP; 0.5×B2M RNP+1×TRAC RNP; 1×B2M RNP+0.5×TRAC RNP; no RNPs. This allowed us to determine the effect of various amounts of RNP (1 or 2 targets) on cell viability and editing efficiency of the targeted genes. Cells were assessed by flow cytometry for both TCR expression and B2M expression. The results are showing in FIG. 17A-17D. These results showed that RNPs targeting two separate targets could be delivered simultaneously to CD3+ T cells by electroporation without negative impact on viability or compromising the editing efficiency of either guide. Additionally, a high frequency of CD3+ T cells were successfully edited at both targets resulting in a CD3−B2M− population.

Figure 25:
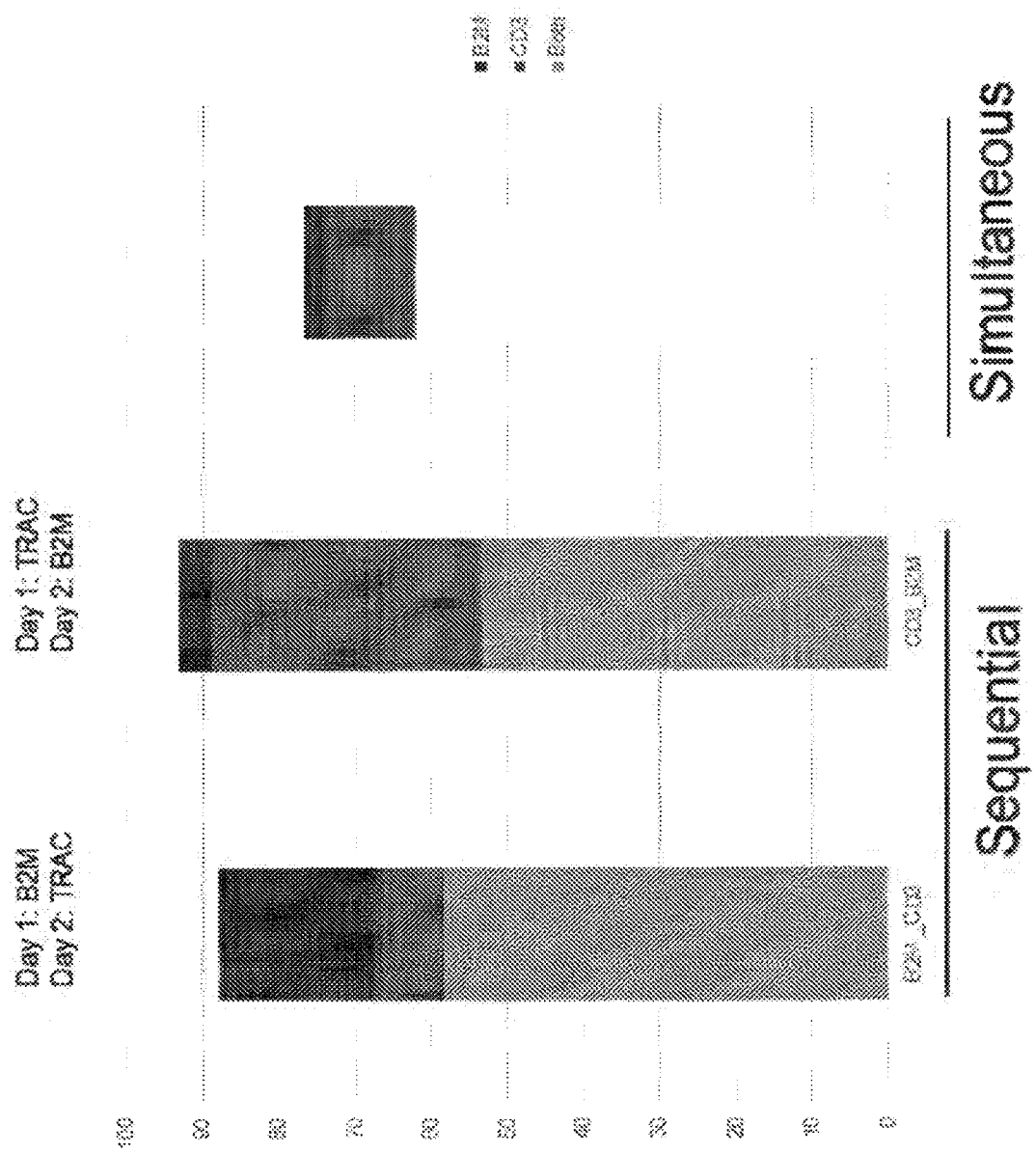
FIG. 25: % of CD3+ T cells that are B2M−, TCR−(as measured by anti-CD3 Ab), or B2M−/TCR− (double negative) as measured by FACS (at day 4 following first electroporation) following either sequential electroporation of RNPs comprising gRNAs to the targets, or simultaneous electroporation of RNPs comprising gRNAs to the targets.
Figure 26:
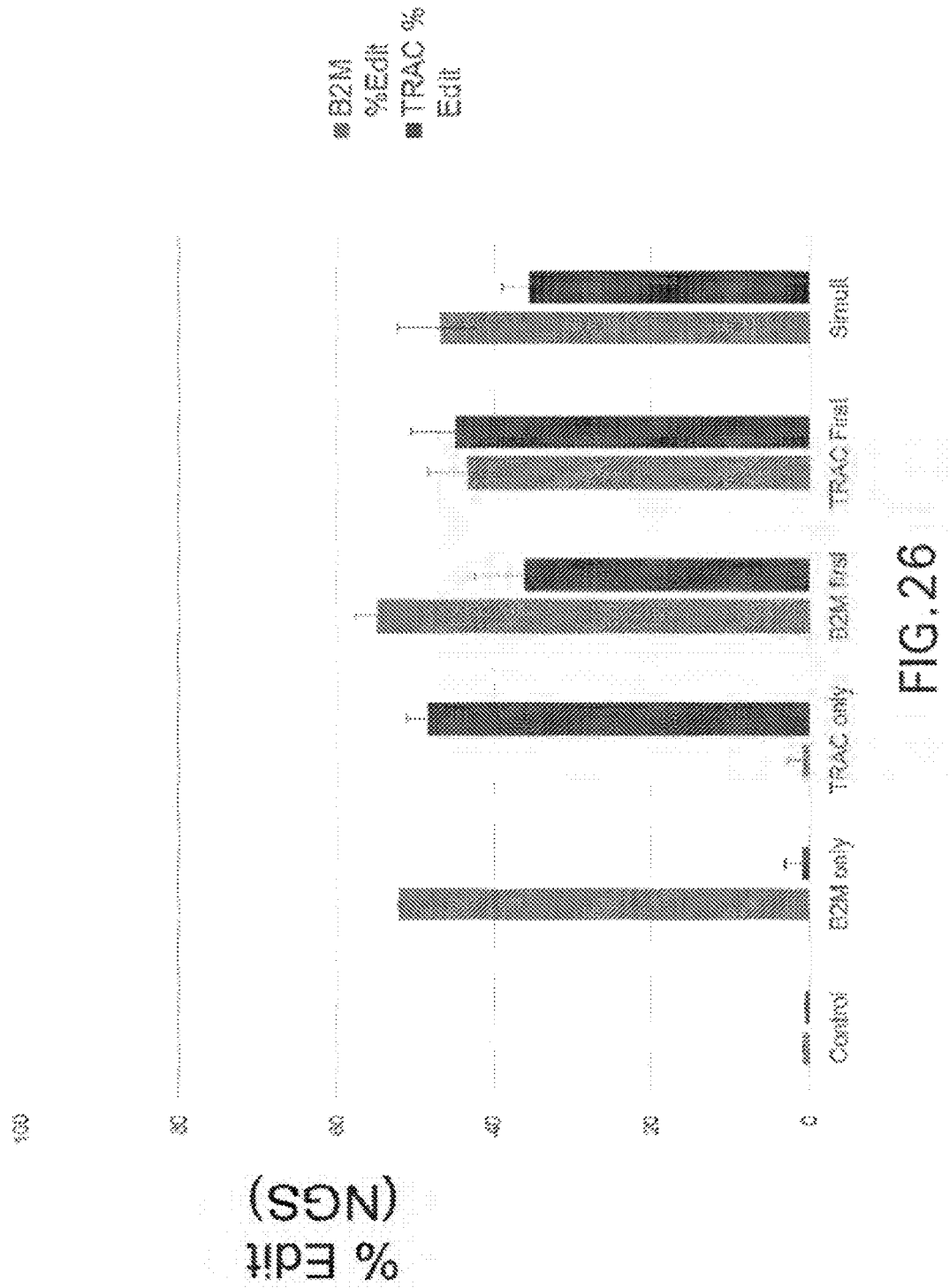
FIG. 26: % of CD3 T cells that are B2M−, TCR−(as measured by anti-CD3 Ab), or B2M−/TCR− (double negative) as measured by NGS (48 hours following first electroporation) following either single electroporation, sequential electroporation of RNPs comprising gRNAs to the targets, or simultaneous ("Simult") electroporation of RNPs comprising gRNAs to the targets (B2M and TRAC).

Next, the effect of editing two targets, B2M and TRAC by either simultaneous or sequential introduction of RNPs containing dgRNAs to B2M and TRAC. For this experiment, RNPs were generated as described above using a dgRNA comprising the targeting domain of CR000442 for targeting of B2M and using a dgRNA comprising the targeting domain of CR000984 for targeting TRAC. Briefly, CD3+ T cells were thawed, activated for 3 days (Immunocult CD3/CD28 T cell activator from StemCell Technologies). On day 3 and day 4 (sequential) or day 3 (Simultaneous), cells were electroporated to introduce RNPs, and maintained until day 5 post-delivery (Day 9), when expression of B2M and/or TCR was assessed by FACS (then by NGS following cell lysis). T cells were maintained in the presence of activating reagent throughout the electroporation and post-electroporation process. Expression of B2M and TCR were assessed by FACS (using anti-B2M clone 2M2 or anti-CD3 clone OKT3 at 1:200 dilution). Cells were subsequently lysed and editing of the targeted loci assessed by NGS. The results are reported at FIGS. 25 and 26. These results indicate that both sequential and simultaneous targeting of B2M and TRAC yield similar double knockout frequencies.

Example 9: Editing of FKBP1A

Figure 21:
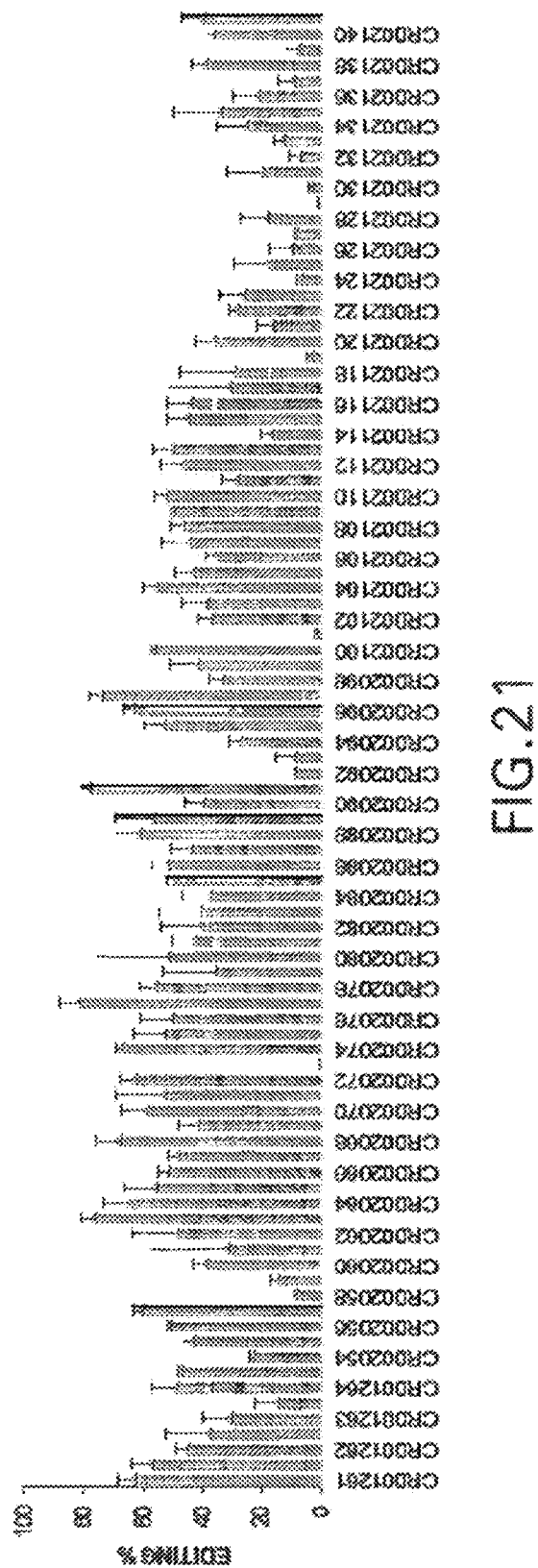
FIG. 21: % editing (N=3) as measured by NGS in HEK293 cells stably expressing Cas9 using dgRNAs that include the targeting domain to FKBP1A as indicated (each unlabeled bar uses the targeting domain of the odd-numbered CRxxxx that falls between the labeled numbers. For example, the data for the dgRNA that includes the targeting domain of CR002073 is reported at the bar falling between that labeled CR002072 and CR002074).
Figure 22:
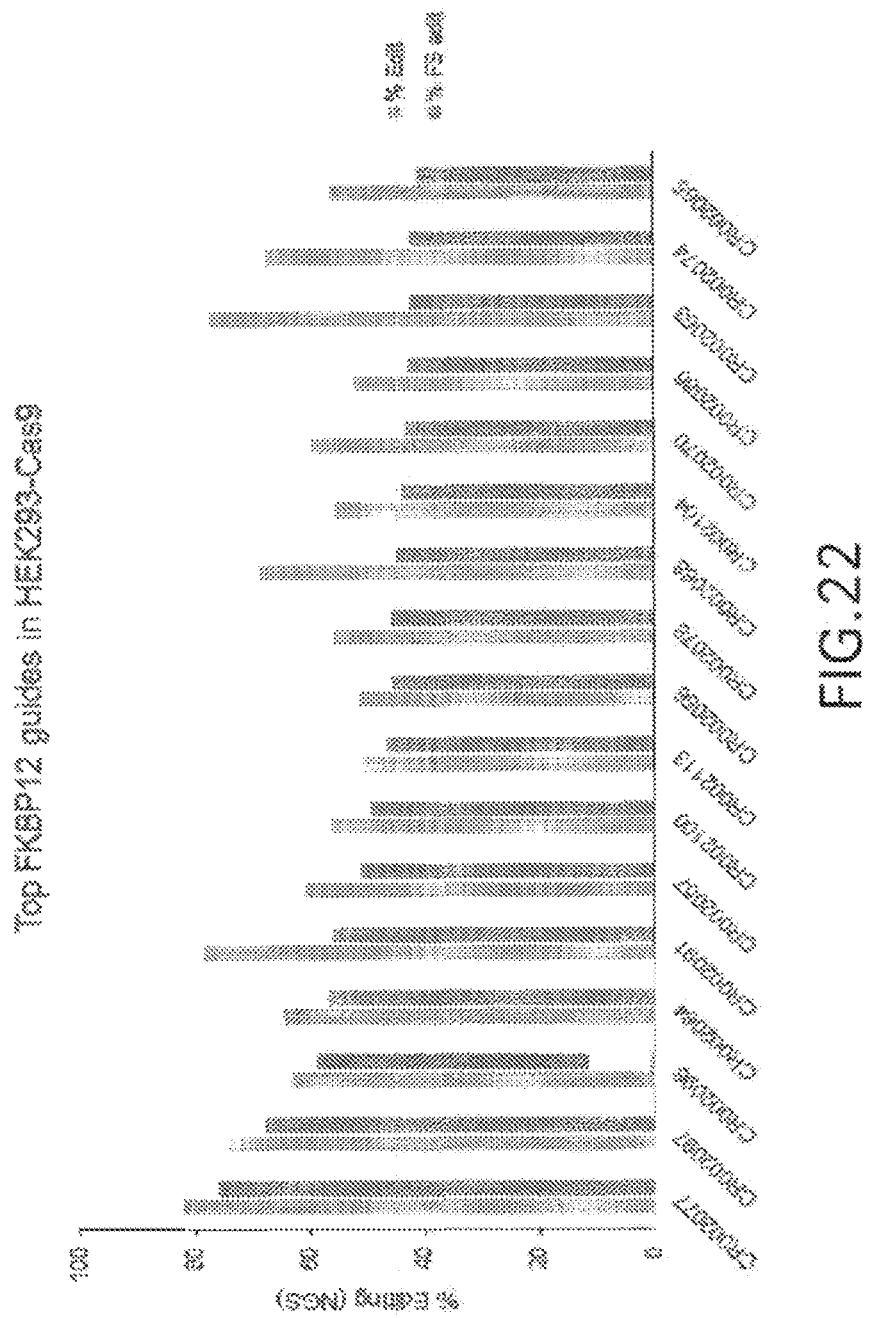
FIG. 22: % editing (N=3) and % Frameshift edit (FS) as measured by NGS in HEK293 cells stably expressing Cas9 using dgRNAs that include the targeting domain to FKBP1A as indicated.

Editing of FKBP1A with dgRNAs targeted to the FKBP1A gene were assayed in HEK293 cells engineered to express Cas9, as described above. The data, including % editing and the % of frameshift (FS) edit, are reported in FIG. 21, FIG. 22, and FIG. 23. Based on these results, the top 15 gRNA molecules were identified by highest percent FS edit. These gRNA molecules, including their targeting domains, are reported in FIG. 23. Next, editing of FKBP1A in CD3+ T cells was assayed using RNPs comprising dual guides comprising the identified targeting domain to FKBP1A. Cells, RNPs and all methods were formed and performed as described above. The results are reported in FIG. 24.

To follow up on the previous experiments, gRNAs comprising the targeting domains of the most efficient editing gRNAs were tested again in primary human T cells. FIG. 52 shows the genomic editing of the FKBP1A locus resulting from human primary T cell electroporation with RNPs containing the indicated gRNAs targeting FKBP1A in dgRNA format (as described above). The frequency of insertions or deletions is indicated (% indels) and the percentage of these edits that result in frameshifting of the coding sequence is shown. The results demonstrate a subset of gRNAs which are able to achieve high editing efficiency (>80%) with a high proportion of frameshift edits (>65%). FIG. 53 shows the top 5 most frequently observed sequence changes (indels) for each FKBP1A targeting gRNA used for primary human T cell editing.

Example 10: Editing of CIITA

Editing of CIITA with dgRNAs targeted to the CIITA gene were assayed in HEK293 cells engineered to express Cas9, as described above in Example 1. The data, including % editing and the % of frameshift (FS) edit, are reported below in Table 24.

TABLE 24

% editing (N = 3) and % Frameshift edit (FS) as measured by NGS in HEK293 cells stably expressing Cas9 using dgRNAs that include the targeting domain to CIITA as indicated. gRNA molecules are ranked in the table by % edit.

| ID | Target | Avg. % Edit | StdDev % Edit | Avg. % FS | StdDev % FS | Rank |
|---|---|---|---|---|---|---|
| CR002993 | CIITA | 60.16 | 6.68 | 48.86 | 4.24 | 1 |
| CR002991 | CIITA | 59.11 | 9.04 | 51.40 | 8.37 | 2 |
| CR002995 | CIITA | 52.74 | 11.49 | 43.64 | 9.45 | 3 |
| CR002948 | CIITA | 52.71 | 7.63 | 48.08 | 6.93 | 4 |
| CR002980 | CIITA | 50.30 | 13.62 | 42.41 | 11.48 | 5 |
| CR002961 | CIITA | 50.29 | 6.60 | 38.41 | 4.64 | 6 |
| CR003001 | CIITA | 47.64 | 11.32 | 43.30 | 10.38 | 7 |
| CR002992 | CIITA | 46.54 | 12.64 | 31.23 | 7.79 | 8 |
| CR002971 | CIITA | 45.94 | 13.74 | 33.61 | 9.92 | 9 |
| CR002976 | CIITA | 45.36 | 14.84 | 37.66 | 12.71 | 10 |
| CR002967 | CIITA | 44.47 | 21.39 | 38.77 | 18.85 | 11 |
| CR003007 | CIITA | 43.64 | 12.08 | 32.22 | 8.81 | 12 |
| CR002953 | CIITA | 43.60 | 11.37 | 34.95 | 9.42 | 13 |
| CR002994 | CIITA | 42.35 | 8.53 | 31.32 | 5.55 | 14 |
| CR002965 | CIITA | 41.85 | 16.72 | 29.63 | 10.99 | 15 |
| CR002972 | CIITA | 41.06 | 12.07 | 28.56 | 9.07 | 16 |
| CR003011 | CIITA | 38.96 | 19.22 | 22.19 | 10.64 | 17 |
| CR002978 | CIITA | 38.34 | 18.04 | 34.11 | 16.14 | 18 |
| CR003013 | CIITA | 37.75 | 11.18 | 29.94 | 8.82 | 19 |
| CR002962 | CIITA | 37.71 | 10.14 | 26.10 | 7.04 | 20 |
| CR002966 | CIITA | 37.12 | 18.00 | 31.49 | 15.77 | 21 |
| CR002981 | CIITA | 36.28 | 15.11 | 29.98 | 12.29 | 22 |

TABLE 24-continued

% editing (N = 3) and % Frameshift edit (FS) as measured by NGS in HEK293 cells stably expressing Cas9 using dgRNAs that include the targeting domain to CIITA as indicated. gRNA molecules are ranked in the table by % edit.

| ID | Target | Avg. % Edit | StdDev % Edit | Avg. % FS | StdDev % FS | Rank |
|---|---|---|---|---|---|---|
| CR002983 | CIITA | 35.90 | 10.82 | 33.83 | 10.53 | 23 |
| CR002970 | CIITA | 35.40 | 15.32 | 25.50 | 10.63 | 24 |
| CR002943 | CIITA | 35.24 | 3.38 | 26.47 | 2.47 | 25 |
| CR002990 | CIITA | 35.19 | 11.07 | 24.08 | 7.77 | 26 |
| CR003003 | CIITA | 35.07 | 16.21 | 27.91 | 12.76 | 27 |
| CR002941 | CIITA | 34.89 | 4.47 | 21.77 | 3.02 | 28 |
| CR002956 | CIITA | 34.30 | 9.28 | 29.66 | 8.14 | 29 |
| CR002944 | CIITA | 34.04 | 2.10 | 22.26 | 1.09 | 30 |
| CR002945 | CIITA | 33.37 | 9.71 | 17.29 | 4.42 | 31 |
| CR002985 | CIITA | 32.99 | 11.62 | 29.52 | 10.46 | 32 |
| CR002940 | CIITA | 32.80 | 8.06 | 22.25 | 6.09 | 33 |
| CR002958 | CIITA | 32.78 | 8.06 | 22.49 | 4.77 | 34 |
| CR003009 | CIITA | 32.69 | 14.75 | 25.62 | 11.60 | 35 |
| CR003014 | CIITA | 32.51 | 14.39 | 26.93 | 11.72 | 36 |
| CR002963 | CIITA | 32.48 | 13.28 | 26.80 | 11.02 | 37 |
| CR002946 | CIITA | 31.12 | 11.15 | 14.20 | 4.24 | 38 |
| CR002959 | CIITA | 30.79 | 8.79 | 29.78 | 8.64 | 39 |
| CR002973 | CIITA | 30.60 | 11.08 | 23.55 | 8.17 | 40 |
| CR003021 | CIITA | 29.94 | 10.67 | 26.88 | 9.37 | 41 |
| CR003026 | CIITA | 29.63 | 6.59 | 20.05 | 4.52 | 42 |
| CR002968 | CIITA | 29.53 | 17.36 | 22.22 | 12.73 | 43 |
| CR003023 | CIITA | 29.38 | 7.13 | 16.83 | 3.71 | 44 |
| CR002979 | CIITA | 28.91 | 13.80 | 23.07 | 10.56 | 45 |
| CR003018 | CIITA | 27.72 | 9.36 | 26.54 | 9.18 | 46 |
| CR002987 | CIITA | 27.56 | 11.04 | 24.06 | 9.81 | 47 |
| CR003015 | CIITA | 27.40 | 7.88 | 24.05 | 6.97 | 48 |
| CR002989 | CIITA | 27.38 | 13.31 | 8.45 | 4.26 | 49 |
| CR002964 | CIITA | 26.56 | 11.21 | 19.56 | 7.74 | 50 |
| CR003010 | CIITA | 25.45 | 10.54 | 14.37 | 5.52 | 51 |
| CR002988 | CIITA | 25.29 | 13.48 | 11.35 | 5.56 | 52 |
| CR002951 | CIITA | 25.09 | 6.28 | 16.13 | 3.91 | 53 |
| CR003025 | CIITA | 24.52 | 6.66 | 19.21 | 4.70 | 54 |
| CR002996 | CIITA | 23.91 | 7.13 | 17.83 | 5.34 | 55 |
| CR003022 | CIITA | 23.73 | 11.35 | 17.96 | 8.69 | 56 |
| CR003020 | CIITA | 23.67 | 9.57 | 16.44 | 6.58 | 57 |
| CR002999 | CIITA | 23.50 | 12.38 | 18.58 | 9.69 | 58 |
| CR002939 | CIITA | 22.02 | 5.58 | 17.27 | 4.64 | 59 |
| CR003017 | CIITA | 21.90 | 4.21 | 15.22 | 2.47 | 60 |
| CR003005 | CIITA | 21.11 | 6.97 | 18.08 | 5.97 | 61 |
| CR002969 | CIITA | 20.82 | 14.36 | 14.85 | 9.88 | 62 |
| CR003024 | CIITA | 20.40 | 6.26 | 16.33 | 4.88 | 63 |
| CR003006 | CIITA | 19.46 | 9.28 | 14.66 | 6.72 | 64 |
| CR002954 | CIITA | 19.43 | 7.05 | 6.28 | 2.27 | 65 |
| CR003004 | CIITA | 19.43 | 7.68 | 15.63 | 6.01 | 66 |
| CR002975 | CIITA | 19.31 | 3.56 | 15.82 | 2.58 | 67 |
| CR002977 | CIITA | 19.11 | 9.48 | 12.99 | 6.31 | 68 |
| CR003016 | CIITA | 17.86 | 4.27 | 13.55 | 3.56 | 69 |
| CR002942 | CIITA | 17.14 | 1.59 | 8.91 | 0.97 | 70 |
| CR002950 | CIITA | 16.64 | 4.84 | 8.65 | 2.46 | 71 |
| CR002947 | CIITA | 15.86 | 4.03 | 8.10 | 2.13 | 72 |
| CR003008 | CIITA | 15.30 | 10.49 | 10.91 | 7.58 | 73 |
| CR003000 | CIITA | 12.83 | 7.31 | 10.53 | 5.76 | 74 |
| CR003002 | CIITA | 11.85 | 4.06 | 9.78 | 3.32 | 75 |
| CR003019 | CIITA | 11.80 | 2.88 | 9.74 | 2.19 | 76 |
| CR003012 | CIITA | 10.67 | 6.52 | 7.51 | 4.18 | 77 |
| CR002960 | CIITA | 10.56 | 3.88 | 6.96 | 2.14 | 78 |
| CR002982 | CIITA | 10.45 | 4.28 | 9.05 | 3.66 | 79 |
| CR002952 | CIITA | 10.37 | 4.96 | 8.22 | 4.17 | 80 |
| CR002974 | CIITA | 8.99 | 2.67 | 6.92 | 1.79 | 81 |
| CR002955 | CIITA | 7.88 | 3.56 | 5.04 | 2.25 | 82 |
| CR002998 | CIITA | 4.95 | 6.44 | 4.84 | 6.27 | 83 |
| CR002957 | CIITA | 3.73 | 0.70 | 3.15 | 0.48 | 84 |
| CR002949 | CIITA | 2.39 | 0.64 | 1.83 | 0.32 | 85 |
| CR002984 | CIITA | 2.33 | 0.18 | 2.19 | 0.17 | 86 |
| CR002986 | CIITA | 1.77 | 0.51 | 1.48 | 0.27 | 87 |
| CR002997 | CIITA | N/A | N/A | N/A | N/A | 88 |

Next, editing of the CIITA gRNA molecules with the highest Editing % was assessed in CD3+ primary human T cells, as described in Example 1. The results are shown in Table 32.

TABLE 32

% Editing and % Frameshift Edit (as measured by NGS) by dgRNA molecules targeting CIITA delivered as RNP to CD3+ T cells

| | CD3+ NGS | | | |
|---|---|---|---|---|
| Targeting Domain ID | Editing % | Edit % Std. Dev. | Frameshift Edit % | Frameshift % Std. Dev. |
| CR002948 | 41.6 | 2.3 | 33.6 | 1.7 |
| CR003001 | 36.3 | 1.8 | 32.0 | 1.3 |
| CR002991 | 33.9 | 3.4 | 29.2 | 3.3 |
| CR002993 | 33.8 | 2.6 | 27.2 | 1.7 |
| CR003007 | 31.6 | 1.6 | 28.8 | 1.7 |
| CR002961 | 30.3 | 2.0 | 24.7 | 1.2 |
| CR002965 | 29.0 | 3.9 | 24.4 | 3.2 |
| CR002967 | 28.0 | 0.7 | 25.6 | 0.5 |
| CR002972 | 26.6 | 1.1 | 20.9 | 1.9 |
| CR002994 | 22.0 | 2.7 | 18.1 | 2.3 |
| CR002992 | 16.0 | 1.6 | 11.6 | 0.8 |
| CR003013 | 11.5 | 0.9 | 9.0 | 0.6 |
| CR002971 | 7.2 | 0.7 | 5.4 | 0.4 |
| CR002980 | 6.1 | 0.5 | 3.6 | 0.6 |
| CR003011 | 5.2 | 0.6 | 4.9 | 0.6 |
| CR002953 | 5.1 | 0.7 | 4.8 | 0.7 |
| CR002978 | 4.7 | 0.7 | 2.7 | 0.2 |
| CR002976 | 4.0 | 0.3 | 3.6 | 0.3 |
| CR002962 | 3.4 | 0.4 | 2.9 | 0.4 |
| CR002995 | 3.1 | 0.2 | 2.5 | 0.4 |

Figure 37:
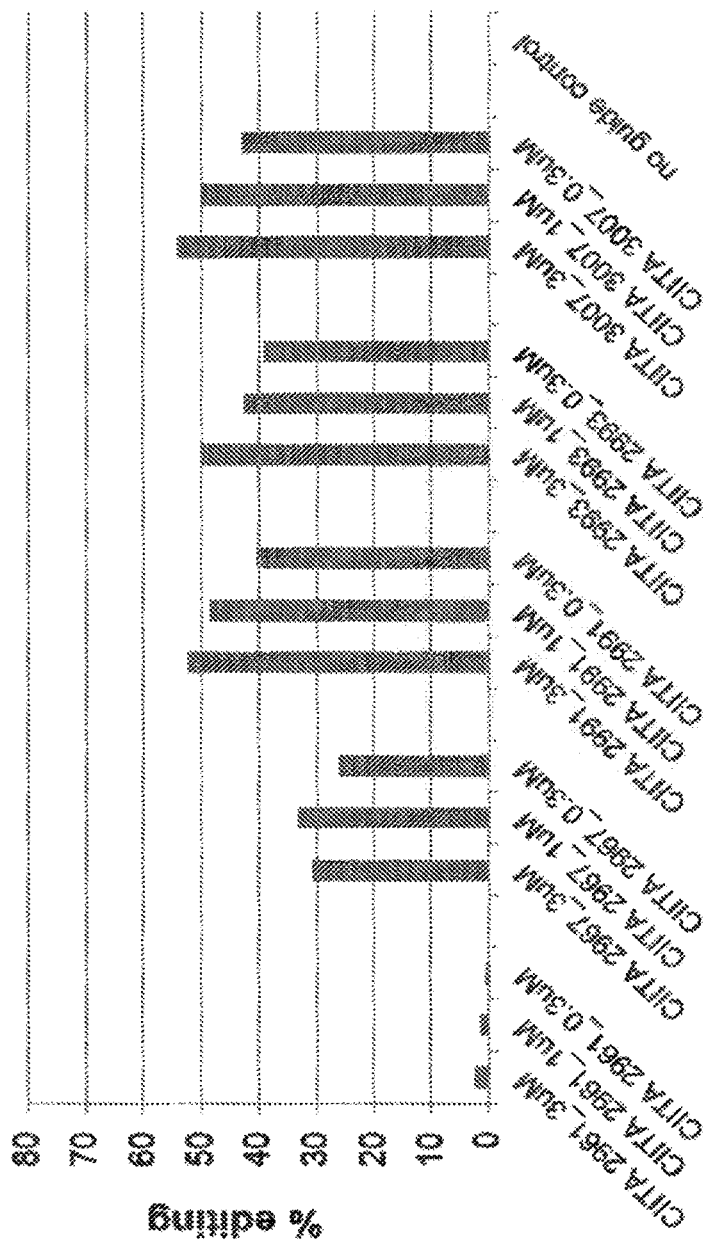
FIG. 37: % editing at Day 3 post electroporation (Day 5 of cell culture) in primary human T cells by RNPs that include the indicated dgRNA to CIITA (number indicates CRxxxxx identifier of targeting domain) at the indicated concentration, as measured by flow cytometry using an anti-HLA-DR reagent.

Next, editing, and loss of MHC class II molecule expression, in response to a subset of gRNA molecules targeting CIITA was assessed in primary human T cells. Briefly, primary human T cells were prepared in culture and activated using CD3/CD28 bead stimulation (DynaBeads Invitrogen Cat #111.41D) at bead to cell ratio of 3:1. At day 2, RNP consisting of *S. pyogenes* Cas9 precomplexed with dgRNA molecules (using the crRNA and tracr sequences described above) comprising the indicated targeting domains were electroporated into the T cells using the Neon electroporator at three different concentrations of RNP (0.3 uM, 1.0 uM and 3.0 uM; diluted after formation of RNP). On Day 5 and Day 7, % editing was assessed by loss of expression of HLA-DR, as assessed by flow cytometry. The results from Day 5 and Day 7 were comparable. % editing in T cells (e.g., % of cells which are CD3+ and HLA-DR-) at day 5 is shown in FIG. 37. As shown, at the highest concentration tested, RNP that included dgRNA molecules CR02991, CR02993 and CR03007 each resulted in >50% editing, as measured by loss of HLA-DR surface staining. As shown below, the lack of editing observed for gRNA CR002961 was due to a mistake in the experimental protocol. When the experiment was repeated (data shown in FIG. 39), RNP comprising gRNA CR002961 resulted in dose-responsive levels of reduction of HLA-DR expression.

Figure 38:
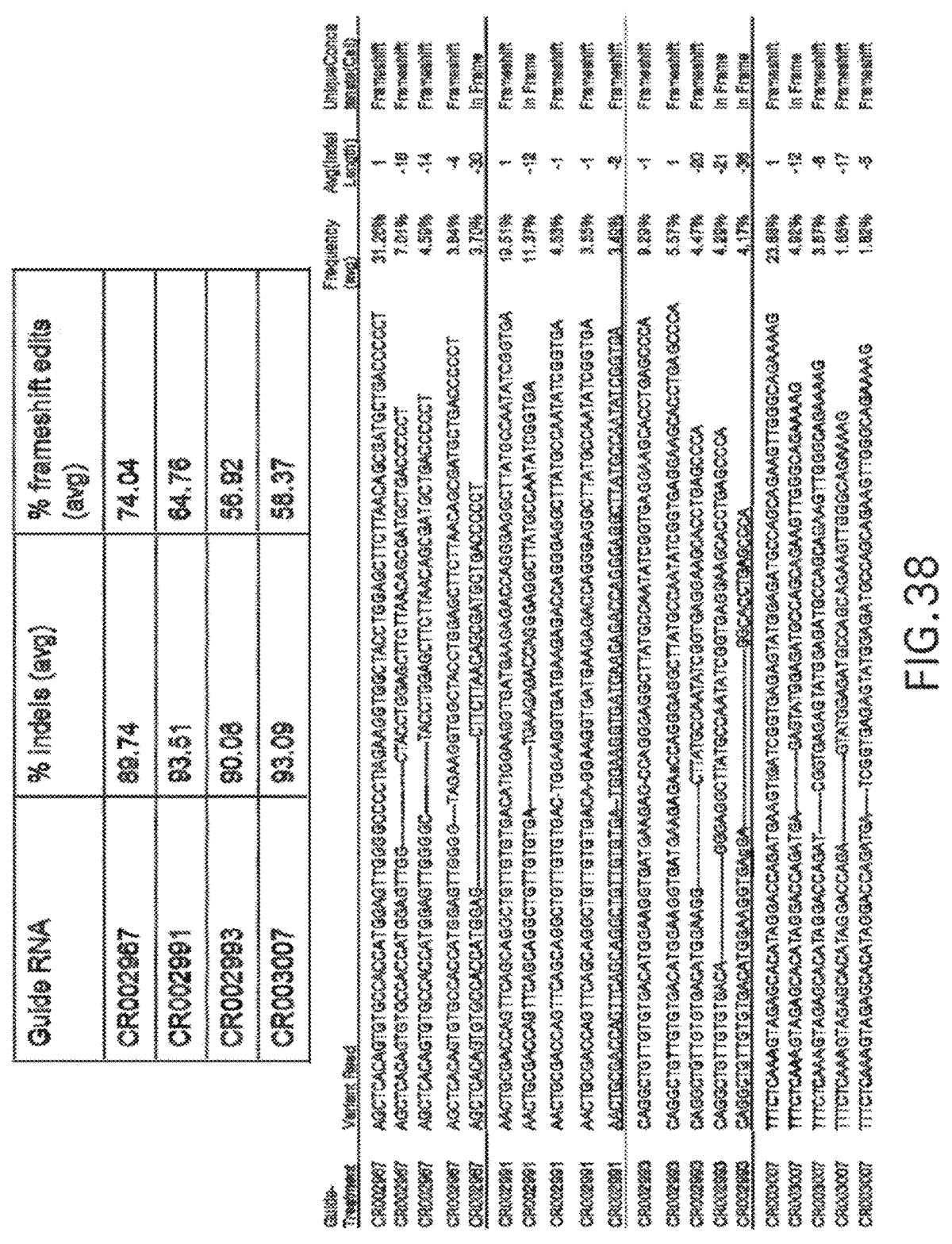

The experiments described above were repeated for another set of gRNA molecules targeting CIITA. FIG. 38 shows the results of this experiment, with genomic editing of the CIITA locus resulting from human primary T cell electroporation with RNP containing the indicated gRNA targeting the CIITA locus. The frequency of insertions or deletions is indicated (% indels) and the percentage of these edits that result in frameshifting of the coding sequence is shown (% frameshift edits). The top 5 most frequently observed sequence changes are shown in detail in the bottom panel. These data indicate that gRNAs targeting CIITA are able to achieve >90% editing with up to 74% frameshift editing in primary human T cells.

Figure 39:
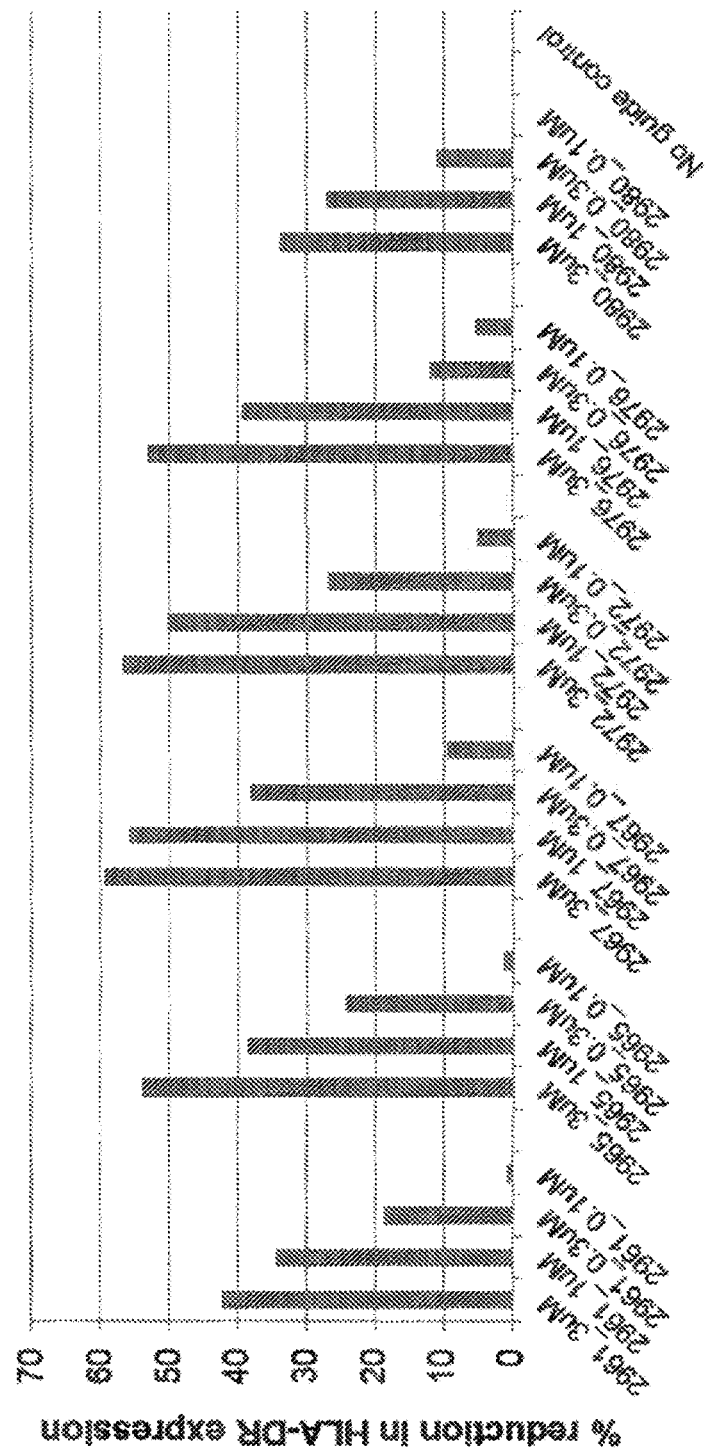
FIG. 39: % editing at Day 3 post electroporation in primary human T cells by RNPs that include the indicated dgRNA to CIITA (number indicates CR00xxxx identifier of targeting domain) at the indicated concentration, as measured by flow cytometry using an anti-HLA-DR reagent. % editing represents the expression of HLA-DR at the cell surface in cells electroporated with CIITA guide relative to the expression in cells electroporated without guide RNA.

The experiment was again performed using a third set of grNAs targeting CIITA at various concentrations of RNP. FIG. 39 shows the % editing at Day 3 post electroporation in primary human T cells by RNPs that include the indicated dgRNA to CIITA (number indicates CR00xxxx identifier of targeting domain) at the indicated concentration, as measured by flow cytometry using an anti-HLA-DR reagent. % editing represents the expression of HLA-DR at the cell surface in cells electroporated with CIITA guide relative to the expression in cells electroporated without guide RNA. As mentioned above, activity of gRNA CR002961 was confirmed in this experiment. FIG. 40 shows the frequency of insertions or deletions is indicated (% indels) and the percentage of these edits that result in frameshifting of the coding sequence is shown (% frameshift edits). These data indicate that another set of gRNAs targeting CIITA is identified which are able to achieve >85% editing with up to 87% frameshift editing (CR002967) in primary human T cells. The top 5 most frequently observed sequence changes for each CIITA targeting gRNA used for primary human T cell editing are shown in FIG. 41.

Figure 42:
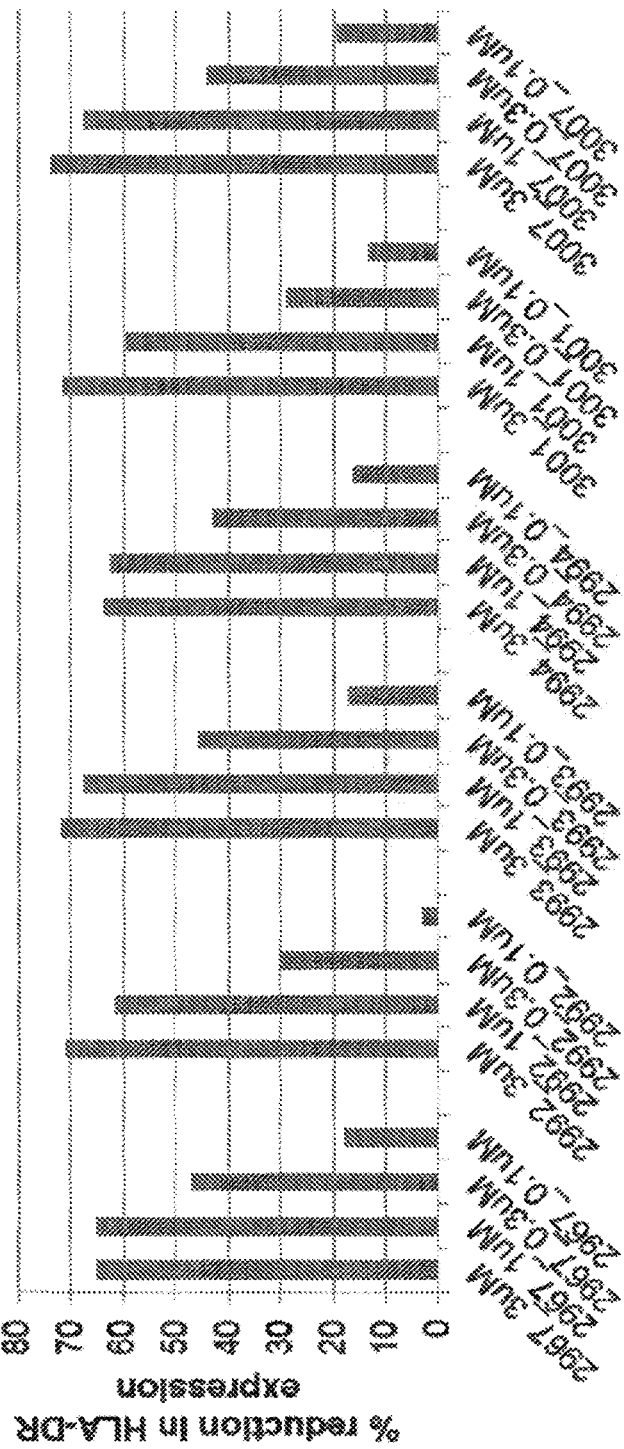
FIG. 42: % editing at Day 3 post electroporation in primary human T cells by RNPs that include the indicated dgRNA to CIITA (number indicates CR00xxxx identifier of targeting domain) at the indicated concentration, as measured by flow cytometry using an anti-HLA-DR reagent. % editing represents the expression of HLA-DR at the cell surface in cells electroporated with CIITA guide relative to the expression in cells electroporated without guide RNA.

The experiment was again performed using a different set of gRNAs targeting CIITA, and compared to the highest performing gRNA (CR0002967) from the previous experiment. FIG. 42 shows the results of % editing at Day 3 post electroporation in primary human T cells by RNPs that include the indicated dgRNA to CIITA (number indicates CR00xxxx identifier of targeting domain) at the indicated concentration, as measured by flow cytometry using an anti-HLA-DR reagent. FIG. 42 shows the frequency of insertions or deletions is indicated (% indels) and the percentage of these edits that result in frameshifting of the coding sequence (% frameshift edits) when these gRNAs are used. FIG. 44 shows the top 5 most frequently observed sequence changes (indels) for each of these CIITA targeting gRNA in primary human T cells. These data confirm the high editing/frameshift/loss of HLA-DR for RNP comprising dgRNA CR002967 and additionally identify other CIITA-targeted gRNAs which result in high editing (>90%) and high frameshift mutations (>80%) in primary human T cells.

Example 11: Editing of TCR (TRAC) and B2M in BCMA CAR T Cells

TABLE 25

| Reagents used for flow cytometry | | | | |
|---|---|---|---|---|
| Name | Catalog Number | Company | Nick name | Clone |
| R-PE Strepetavidin | 016-110-084 | Jackson Immuno Research | SAPE | |
| Streptavidin APC-eFluor780 | 47-43-17-82 | ebiosciences | SA-APC-e780 | |
| APC-Anti Hum B2Microglobulin | 316312 | Biolegend | B2M-APC | |

TABLE 25-continued

Reagents used for flow cytometry

| Name | Catalog Number | Company | Nick name | Clone |
|---|---|---|---|---|
| PerCP-Cyanine5.5 Anti human CD3 | 45-0037-42 | ebiosciences | CD3 PerCPcy5.5 | OKT3 |
| Anti Human CD8a APC | 17-0087-42 | ebiosciences | CD8 APC | SK1 |
| Anti Human CD8a Alexafluor700 | 300920 | Biolegend | CD8 Af700 | |
| Anti Human HLA-DR efluor 450 | 48-9956-42 | ebiosciences | HLA-DR V450 | LN3 |
| Anti Human CD8a eFluor 450 | 48-0086-42 | ebiosciences | CD8 V450 | OKT8 |
| Anti Human CD4 eFluor 450 | 48-0047-42 | ebiosciences | CD4 V450 | SK3 |
| Fixable Viability Dye eFlour780 | 65-0865-14 | ebiosciences | L/D e780 | |

TABLE 26

T cell media components

| Component | Invitrogen Catalog # | Concentration |
|---|---|---|
| RPMI 1640 | 22400-089 | |
| FBS | 16140 | 10% final |
| L-glutamine | 25030-081 | 200 mM (100x stock) |
| Non-essential amino acids | 11140-050 | 10 mM (100x stock) |
| Sodium pyruvate | 11360-070 | 100 mM (100x stock) |
| HEPES buffer | 15630-080 | 1M (100x stock) |
| 2-mercaptoethanol | 21985-023 | 55 mM (1000x stock) |

Figure 27:
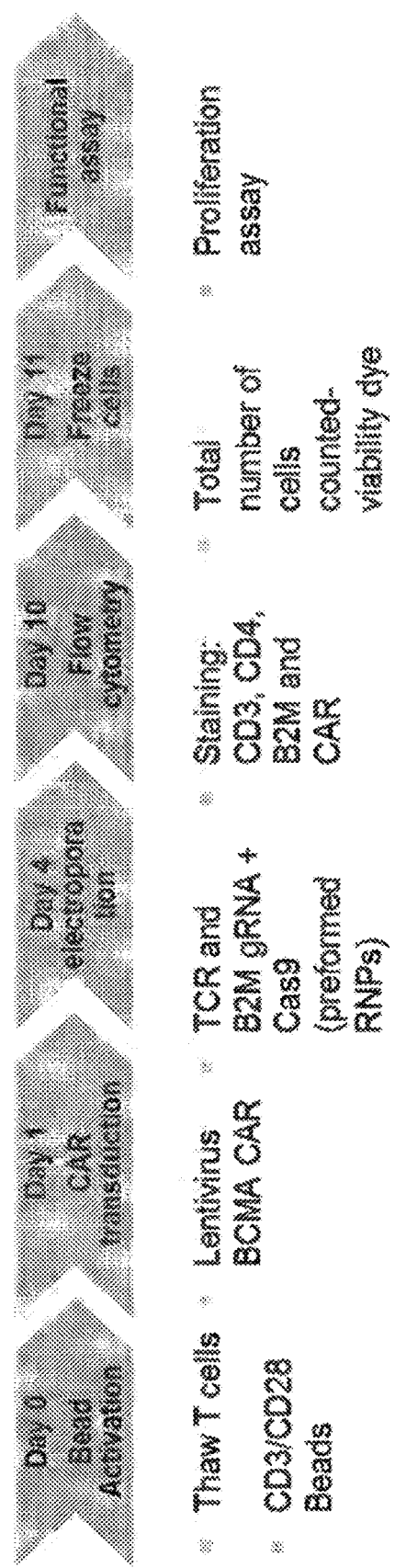
FIG. 27: Schematic for preparation of gene edited TCR−/B2M− BCMA CAR transduced T cells.
Figure 28A:
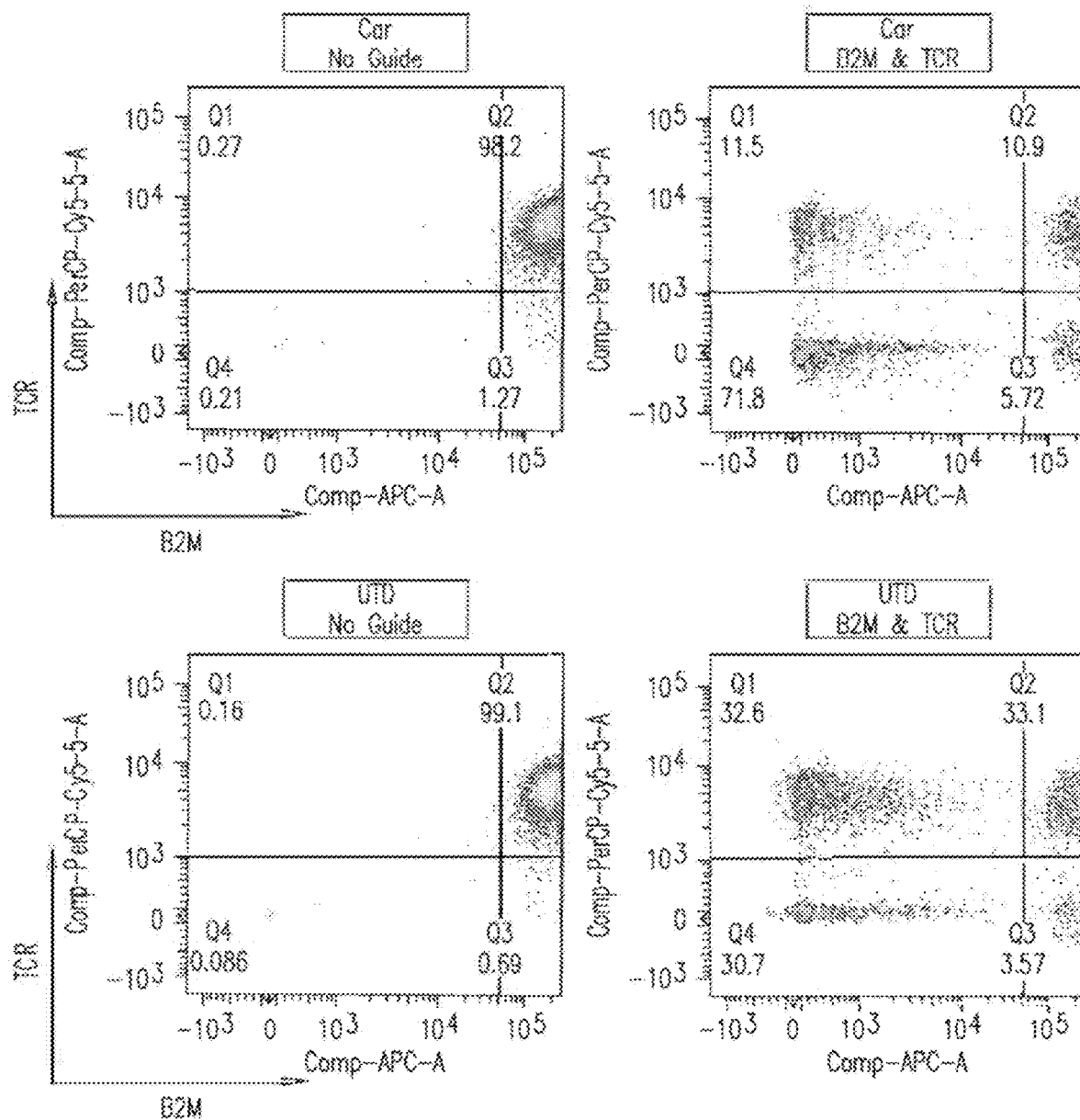
FIG. 28: Surface expression of TCR (using anti-CD3-PercpCy5.5) and B2M (using anti-B2M-APC) five days post (RNP) electroporation. T-cells transduced with RNPs containing gRNA to B2M labeled "B2M"; T-cells transduced with RNPs containing gRNA to TRAC labeled "TCR". T-cells transduced with BCMA CAR are indicated as "CAR". Untransduced cells are indicated as "UTD". Cells electroporated with Cas9 but no guide RNA are indicated as "no guide". CD4 staining using anti-CD4-V450 is shown in the lower panel to verify that the loss of CD3 staining is due to loss of the TCR and not due to loss of T-cells.
Figure 28B:
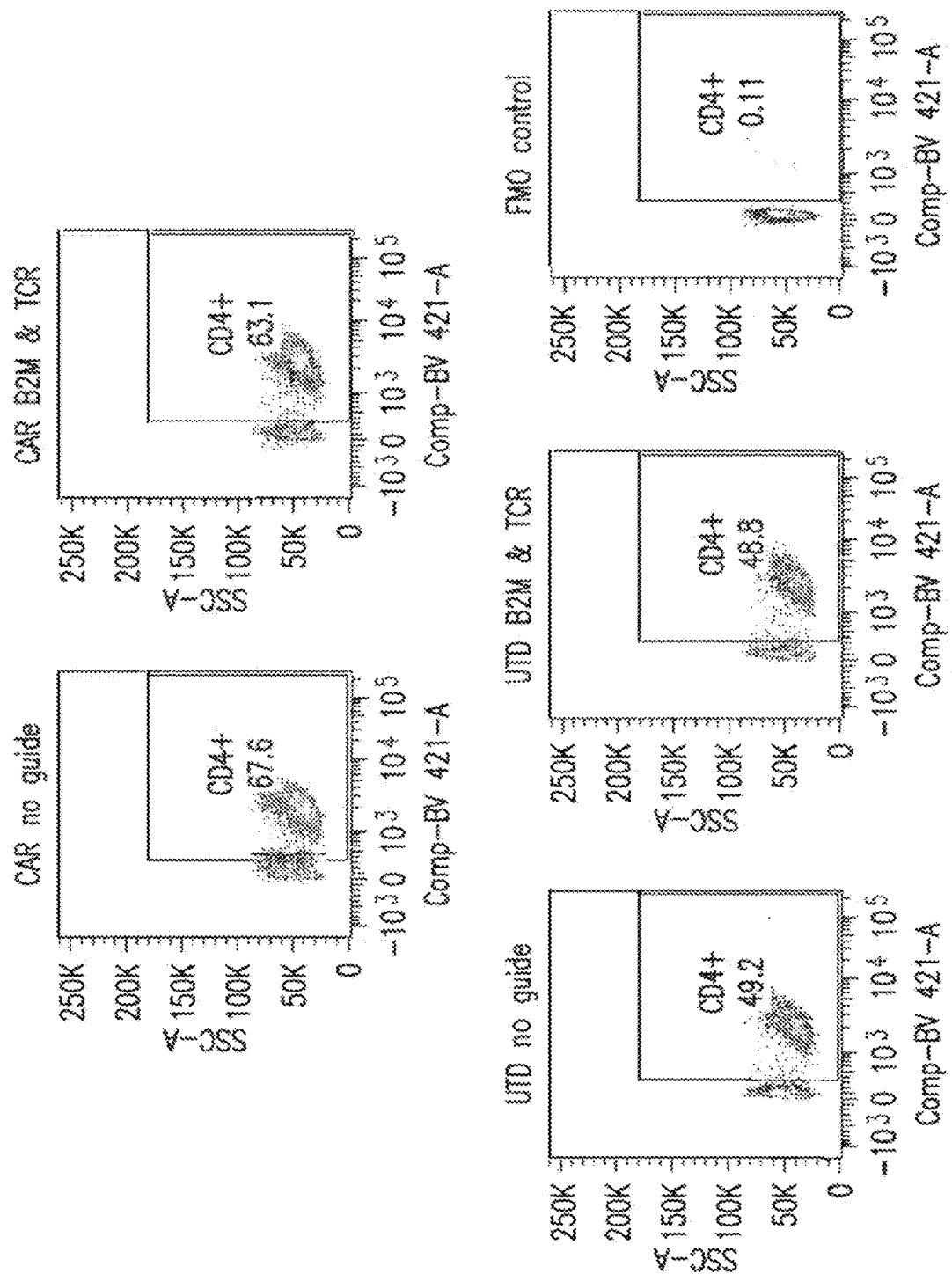
Figure 29:
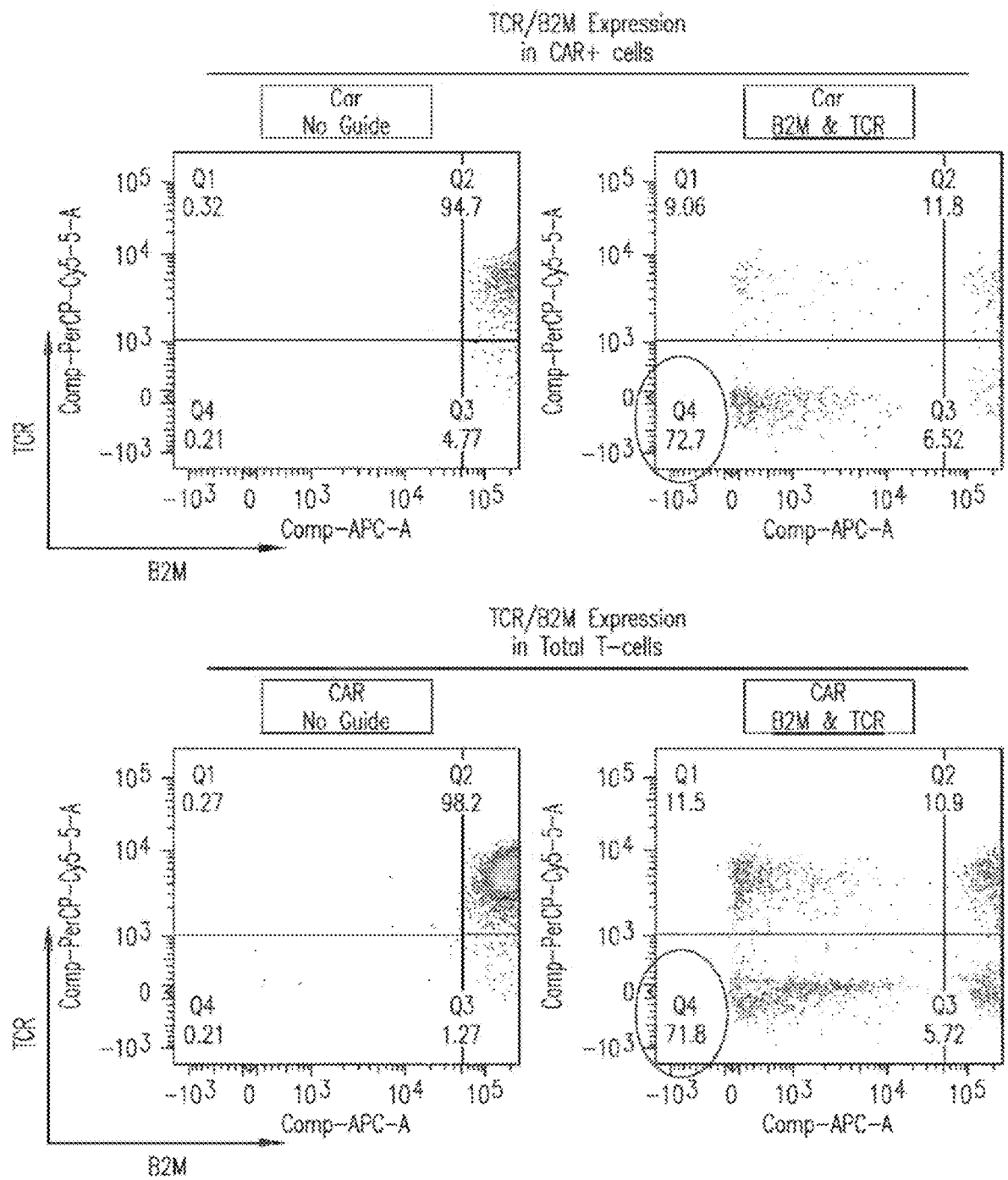
FIG. 29: Surface expression of TCR and B2M compared in total T cells versus CAR+ T cells from each population. "CAR" indicates CAR transduction; "No Guide" indicates Cas9 electroporation with no gRNA; "B2M" indicates electroporation with RNP containing gRNA specific for B2M; "TCR" indicates electroporation with RNP containing gRNA specific for TRAC.

Editing of allogeneic T cell targets in T cells engineered to express a BCMA CART, and the function of edited cells was assessed. T cells, including TCR-B2M-BCMA CAR+ T cells, used in these experiments were prepared as described schematically in FIG. 27. Briefly, PBMC were isolated from human blood by using centrifugation method using Ficoll. Total T cells were isolated from these PBMC's (Hemacare) using human Pan T Cell Isolation Kit (Miltenyi Biotec #130-096-535). These cells were aliquoted and frozen using CRYOSTOR CS10 media (Biolife Solution-210102), and stored in liquid nitrogen. These frozen cell aliquots were then thawed in a 37 degree waterbath for 20 seconds and then transferred to a 50 ml conical tube with 10 ml of prewarmed T cell media and centrifuged at 300 rpm for 5-10 mins at 24 degrees to remove the freezing media and resuspended with prewarmed T cell media. Cells were then transferred to a 24-well dish and activated by adding CD3/CD28 beads (DynaBeads Invitrogen Cat #111.41D) at bead to cell ratio of 3:1. Day 1 post activation, lentivirus comprising sequence encoding CAR BCMA-13 (139112 from Table 23, above) was transduced into these cells at a multiplicity of infection (MOI) of 5. UTD (untransduced cells) were not treated with virus. Day 4 post activation, 250,000 cells per condition either CAR BCMA-13 or Untransduced T cells were then electroporated with RNP using BTX (settings: 1000V/0.6 ms/1 pulse) with or without guide RNA as indicated. For RNP generation, dgRNA molecules comprising tracr RNA and crRNA for TRAC and B2M were heated together at 95° C. for 2 minutes and gradually were cooled to come to room temperature, upon which they were incubated with Cas9 Protein and 5×CCE buffer for 10 mins at 37° C. For TRAC editing the targeting domain of CR000985 (Sequence: CCGAAUCCUCCUC-CUGAAAG (SEQ ID NO: 5593)) was used, and for B2M editing the targeting domain of CR000442 (Sequence: GGC-CACGGAGCGAGACAUCU (SEQ ID NO: 5496)) was used. In each case, dgRNA were used with the crRNA sequence: [targeting domain]-GULTUUAGAGC-UAUGCUGUUUUG (SEQ ID NO: 6607), and the tracr sequence:

AACAGCAUAGCAAGUUAAAAUAAGGCUAGU-CCGUUAUCAACUUGAAAAAGUGGCACCGA GUCG-GUGCUUUUUUU (SEQ ID NO: 6660). After electroporation cells were returned to 0.5 ml of T cell media in a 24 well plate. Two days after electroporation, cells were split every other day to maintain cells at 0.5 million/ml. Five days post electroporation, 100,000 cells were analyzed by flow cytometry (BD Fortessa) using FlowJo software. 100,000 cells were aliquoted to each well of round bottom 96 welled plate. Cells were taken from each sample, pipetted to dissociate them from beads, and beads were removed by using 96 welled plate magnet, and centrifuged with 100 ul of FACS buffer (Miltenyi MACS buffer catalog #130-092-987 with 0.5% BSA (Miltenyi-catalog #130-091-376) to wash the cells. Cells were then incubated with different antibodies diluted in 100 ul FACS buffer for 30 mins on ice. Cells were then washed two times with 200 ul of FACS buffer. Cells were then resuspended in 150 ul of FACS buffer and run on 5 laser Fortessa flow cytometer (Becton Dickenson). Expression of TCR was detected by using anti-CD3-PercpCy5.5 (Ebiosciences 45-0037-42) and expression of B2M was detected by using anti-B2M-APC (316312 Biolegend). Cell surface expression of CAR was evaluated by staining with Biotinylated Protein L followed by Streptavidin-PE (016-110-084 Jackson Immuno Research). T cells were detected by staining CD4 using anti-CD4-V450 (48-0047-42 Ebiosciences) or CD8 using anti-CD8-alexa700 (300920 Biolegend). Expression of TCR (using anti-CD3-PercpCy5.5) and B2M (using anti-B2M-APC) is shown in FIG. 28. T-cells transduced with BCMA CAR BCMA-13 are indicated as "CAR". Untransduced cells are indicated as "UTD". Cells electroporated with Cas9 but no guide RNA are indicated as "no guide". CD4 staining using anti-CD4-V450 is shown in the lower panels of FIG. 28 to verify that the loss of CD3 staining is due to loss of the TCR and not due to loss of T-cells. These results demonstrate that simultaneous introduction of CRISPR systems to B2M and TRAC can be used to generate a population of T cells which lack TCR expression and B2M expression in high yield, with 72% of T cell in the CAR-transduced set staining negative for both TCR and B2M. Next, the ending of TRAC and B2M was evaluated in the CAR+ subset of cells assessed in FIG. 28. The results are shown in FIG. 29. Briefly, the cells from FIG. 28 were analyzed by gating for CAR+ cells (stained using Biotinylated Protein L followed by Streptavidin-PE) for the left-hand panel or without CAR gating (total T-cells; right panel). Editing levels are similar in the CAR+ and total T-cell populations, indicating that CAR expression did not have an effect on editing efficiency.

Figure 30:
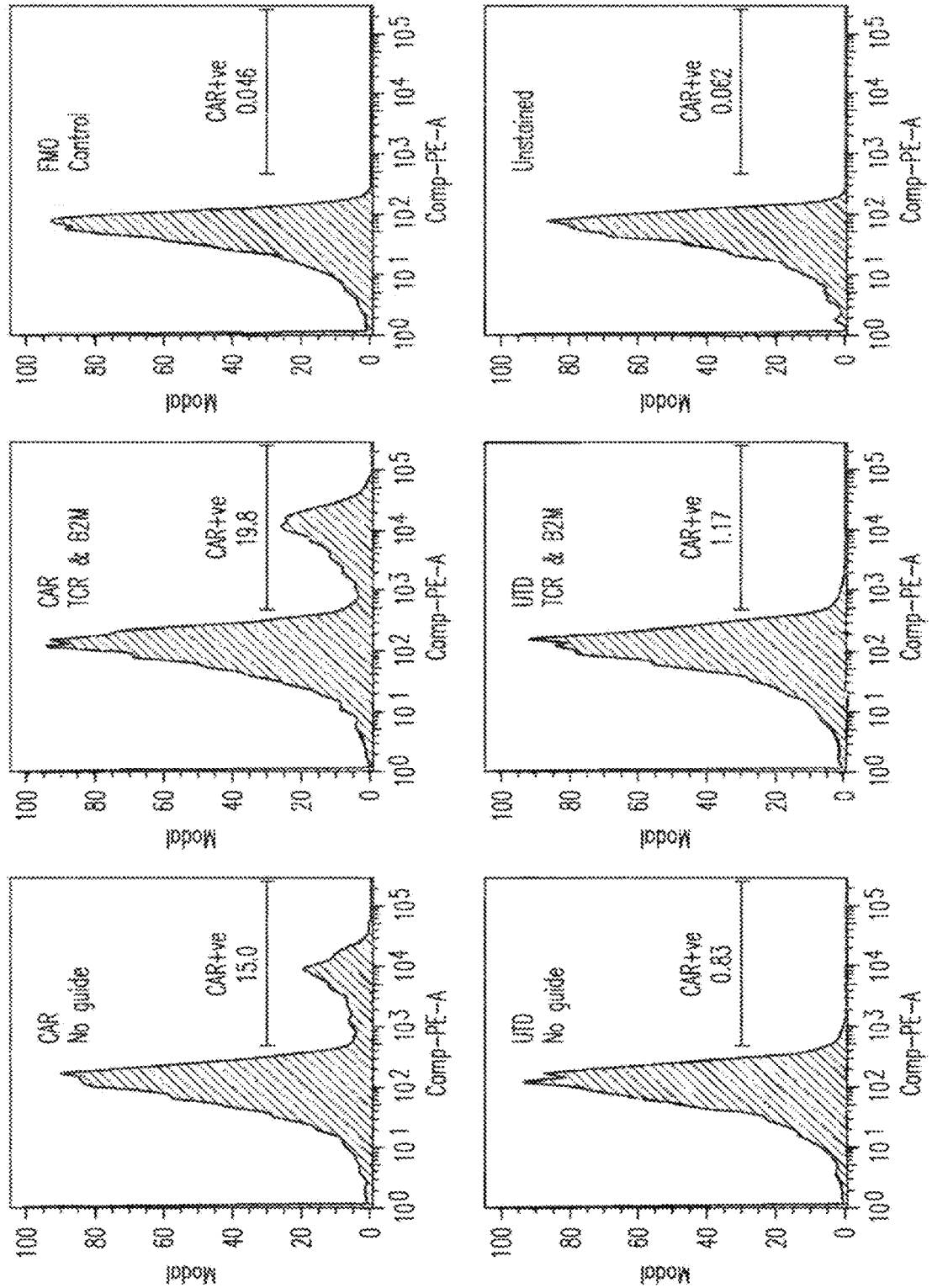
FIG. 30: CAR expression levels in cells electroporated with RNPs containing gRNAs specific for B2M ("B2M") and TRAC ("TCR") or electroporated with Cas9 without grNA ("No guide").

Next, the cells from FIG. 28 were analyzed for CAR expression by analyzing the PE channel. As shown in FIG. 30, the percentage of CAR positive cells was similar in the cells receiving guide RNAs (TRAC and B2M) and those that did not (no guide), indicating that TCR and B2M editing did not have an effect on CAR expression. UTD indicates untransduced cells. CAR indicates cells that were transduced with BCMA CAR.

Figure 31:
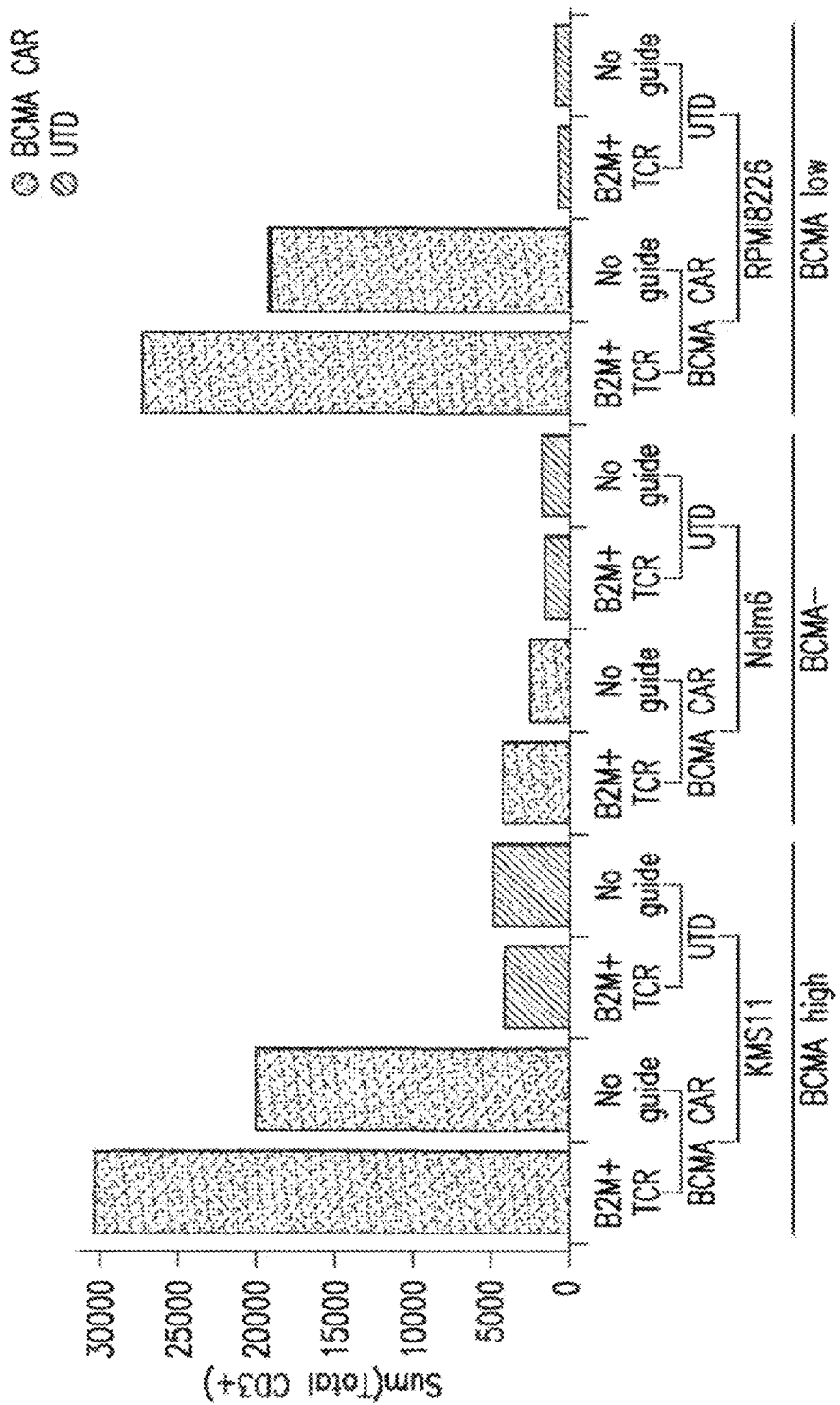
FIG. 31: Evaluation of T-cell proliferation in response to tumor cell lines expressing a high level of BCMA (KMS11), a low level of BCMA (RPMI8226) or which are BCMA- (Nalm6). T cells are either electroporated with cas9 with no gRNA ("No guide") or electroporated with RNP containing gRNAs to B2M and TRAC ("B2M+TCR"); and/or either transduced with lentiviral vector encoding a BCMA CAR ("BCMA CAR") or untransduced ("UTD"), as indicated.
Figure 32:
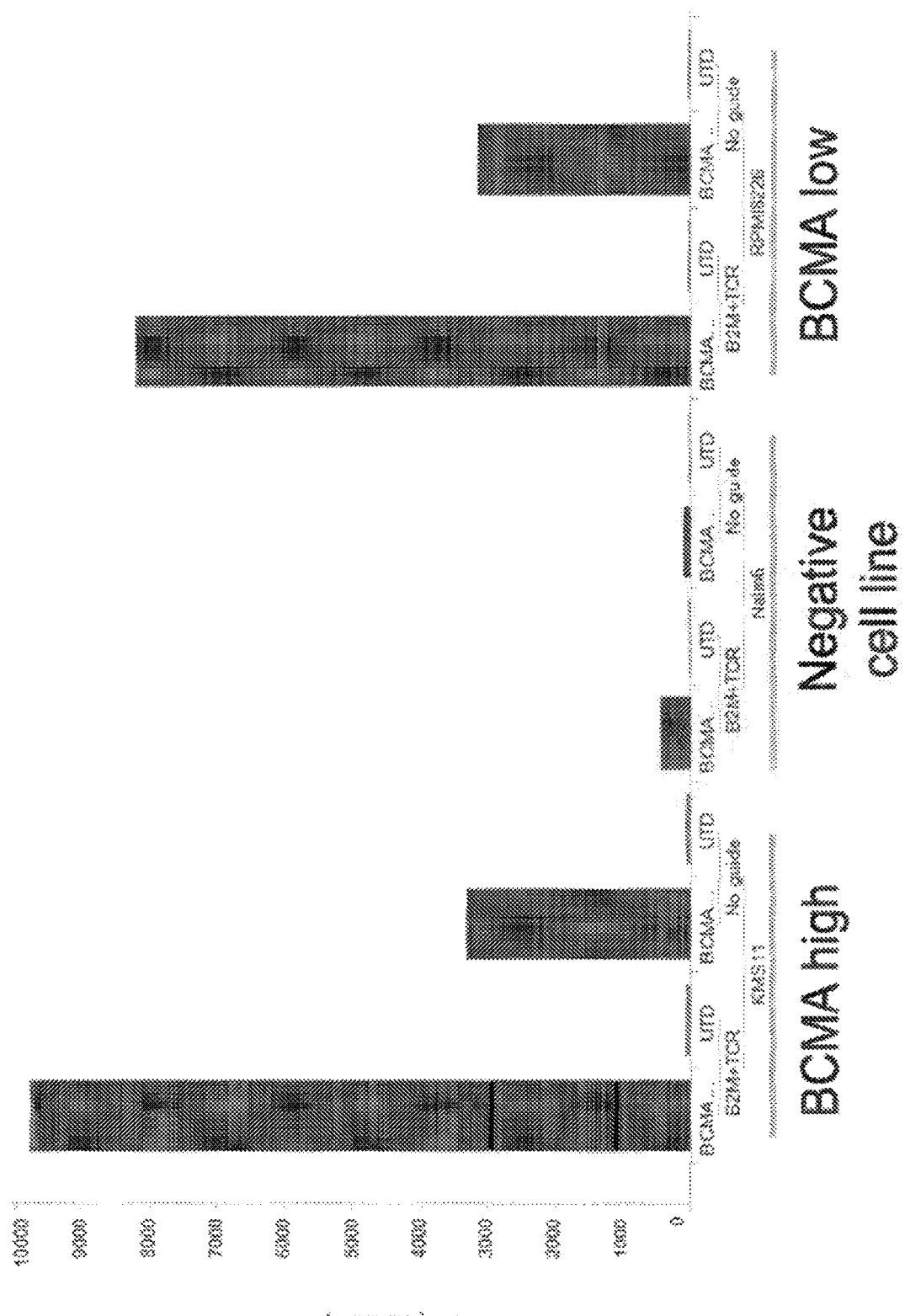
FIG. 32: Proliferation of CAR+CD4+ and/or CD8+ T cells in response to tumor cell lines expressing a high level of BCMA (KMS11), a low level of BCMA (RPM18226) or which are BCMA- (Nalm6). Cells are either electroporated with cas9 with no gRNA ("No guide") or electroporated with RNP containing gRNAs to B2M and TRAC ("B2M+TCR"); and/or either transduced with lentiviral vector encoding a BCMA CAR ("BCMA CAR") or untransduced ("UTD"), as indicated.

Next, the ability of T cells to proliferate in response to BCMA (the target antigen of the CAR molecule) was assessed. Briefly, cells were prepared as described above, were thawed and co-cultured with target cells expressing BCMA (KMS11 (high), RPMI8226 (low)) or not expressing BCMA (Nalm6). T-cells transduced with CAR BCMA-13 are indicated as "BCMA CAR". Untransduced cells are indicated as "UTD". Cells electroporated with Cas9 but no guide RNA are indicated as "no guide". Cells electroporated with RNP containing B2M and TCR guides are indicated as "B2M+TCR". 25,000 irradiated target tumor cells were co-cultured with T cells at 1:1 ratio for 4 days followed by flow cytometry analysis. The number of T-cells (stained with anti-CD4-V450 and anti-CD8-alexa700) was determined by the number of CD4+ plus CD8+ cells relative to 3000 counting beads (Life technology, Catalog #C36950). As shown in FIG. 31, both populations of cells transduced with BCMA CAR lentivirus exhibited proliferation in response to both BCMA-expressing cell types, with the population of cells receiving RNPs containing B2M and TRAC-targeting gRNA molecules exhibiting higher T cell counts after 4 days of co-culture. As shown in FIG. 32, when proliferation of CAR+CD4+ and/or CD8+ T cells was assessed separately, results were similar, with CAR+(gated by staining with biotinylated Protein L followed by Streptavidin-APC-efluor780) T cells proliferating in response to both BCMA-expressing cell types. The foregoing written specification is considered to be sufficient to enable one skilled in the art to practice the invention.

Example 12: Analysis of RNP Concentration Effects and Indel Patterns Using RNPs Targeting TCR or B2M, and Generation of CIITA−/B2M−/TCR− CAR T Cells Methods PBMC were isolated from human blood (Hemacare) by using centrifugation method using Ficoll. Total T cells were isolated from these PBMC's using human Pan T Cell Isolation Kit (Miltenyi Biotec #130-096-535). These cells were aliquoted and frozen. These frozen cell aliquots were then thawed and activated using CD3/CD28 beads (DynaBeads Invitrogen Cat #111.41D) at bead to cell ratio of 3:1. On day 2 or day 3 after bead activation, 200,000 cells were removed from culture for electroporation. RNP complex used for T cell genome editing was formed using a 1:2 molar ratio of Cas9 protein to RNA (crRNA and tracRNA). 100 µM crRNA and 100 µM tracrRNA were denatured separately at 95° C. for 2 min and cooled to room temperature. In a final volume of 5 µL, 1.4 µL of Cas9 protein at a concentration of 5.9 µg/µL (NLS-Cas9-NLS) was mixed with 1.6 µL of Cas9 buffer (20 mM Tris, pH8.0; 200 mM KCL, 10 mM MgCL2) and mixed with 1 µL, of 100 uM tracrRNA at room temperature. Next 1 µL of 100 µM crRNA was added, mixed and incubated for 10 min at 37° C. If more than one RNP was added during the electroporation step, each RNP with a crRNA targeting a different gene was assembled separately using the above method, then combined together with the addition of Cas9 buffer in order to obtain different RNP final concentrations for different conditions. For "triple editing", i.e. simultaneous addition of 3 RNPs targeting different genes, details of RNP quantities are provided in the figures. The assembled RNPs were then mixed with 200,000 cells in 10 ul of T Buffer (neon transfection system 10 ul Kit). Electroporation was performed by Neon electroporator using Neon® Transfection System 10 µL Kit (MPK1096) at 1600V, 10 ms, 3 pulses. For CIITA, editing was quantitated by measuring loss of cell surface expression of HLA-DR by flow cytometry 3 days after electroporation. Cells were stained with anti-CD3 (PerCP-Cy5.5), anti-HLA-DR-V450, and a live/dead cell dye e780 (APC-Cy7) and analyzed by flow cytometry. Editing of TRAC was quantitated by measuring loss of cell surface expression of CD3 epsilon by flow cytometry 3 days after electroporation using anti-CD3 antibody (PerCP-Cy5.5). Editing of B2M was measured by loss of cell surface expression using flow cytometry 4 days after electroporation using anti-B2M antibody-APC (316312 Biolegend). To evaluate the editing frequency and sequence changes resulting from gene editing in the above prepared T cells, genomic DNA was isolated and subjected to sequencing. Briefly, frozen cell pellets were thawed and processed using *DNeasy Blood & Tissue Kit (Qiagen, 69506)* to isolate genomic DNA. Eluted DNA was used to run PCR using *Titanium Taq PCR kit (Clontech Laboratories, 639211)* and primers in Table 27.

TABLE 27 primer design for PCR.

| Target | Forward Primer | SEQ ID NO: | Reverse Primer | SEQ ID NO: |
|---|---|---|---|---|
| B2M | GCACGCGTTTAATA TAAGTGGAGG | 10819 | GACCCTCCCGTCGCC | 10832 |
| FKBP12 | CCTCATCTGTGCAG CGGGCAT | 10820 | CGAGGTACTAGGCAG AGCCGTGG | 10833 |
| TRAC (guides CR000961, CR000978) | CATCACGAGCAGCT GGTTTC | 10821 | GGACTGCCAGAACA AGGCTC | 10834 |
| TRAC (guides CR000979) | GAGCCGAGGTATC GGTCCTG | 10822 | ATTCAGGAGAGACCC CACCC | 10835 |

TABLE 27-continued primer design for PCR.

| Target | Forward Primer | SEQ ID NO: | Reverse Primer | SEQ ID NO: |
|---|---|---|---|---|
| TRAC guides (CR000984, CR000991, CR000992, CR000993) | TGTTTGTAAGGGGA TATGCACAGA | 10823 | GTTTCAGGCCATTAT TATTGCACA | 10836 |
| CIITA (guides CR002961, CR002967) | TGTTGTAGGTGTCA ATTTTCTGCC | 10824 | AATTTCCCCTGATTG CCGTCTCTA | 10837 |
| CIITA (Guide CR002991) | CCCTCTTTCCAGAA ATTTCCTTCTTC | 10825 | GACTGACGTGGCTCA TGATGAAT | 10838 |
| CIITA (Guide CR003007) | AATAGAGACTCAC CTTGGGCTTTC | 10826 | GTACATTTTAAGGCT CCTGTTGGC | 10839 |
| CIITA (Guide CR003001) | GCCTTCAGTTAGAC CTTGTTGATT | 10827 | GAGTCTCTATTGTAC CCACCTTGG | 10840 |
| CIITA (Guide CR002994) | TCCTTCTTCATCCA AGGGACTTTT | 10828 | CCCTTGCAATGATTT CTGTGGG | 10841 |
| CIITA (Guide CR002992, CR002993) | TTCTTCATCCAAGG GACTTTTCCT | 10829 | GACTGACGTGGCTCA TGATGAAT | 10842 |
| CIITA (Guide CR002961, CR002967, CR002965) | TGTTGTAGGTGTCA ATTTTCTGCC | 10830 | AATTTCCCCTGATTG CCGTCTCTA | 10843 |
| CIITA (Guide CR002972, CR002980, CR002976) | TGTAGGTGTCAATT TTCTGCCTCT | 10831 | GAATTTCCCCTGATT GCCGTCT | 10844 |

PCR product was purified using *QIAquick PCR Purification Kit* (*Qiagen,* 28104). Purified PCR product was then used for T7E1 assay to detect base pair mismatches and confirm gene editing. PCR amplicons were subjected to standard Nextera NGS library prep (Illumina) and sequenced with paired-end reads on an Illumina MiSeq sequencer. Sequencing reads were aligned to the reference genome and variants were called.

Results

Figure 33A:
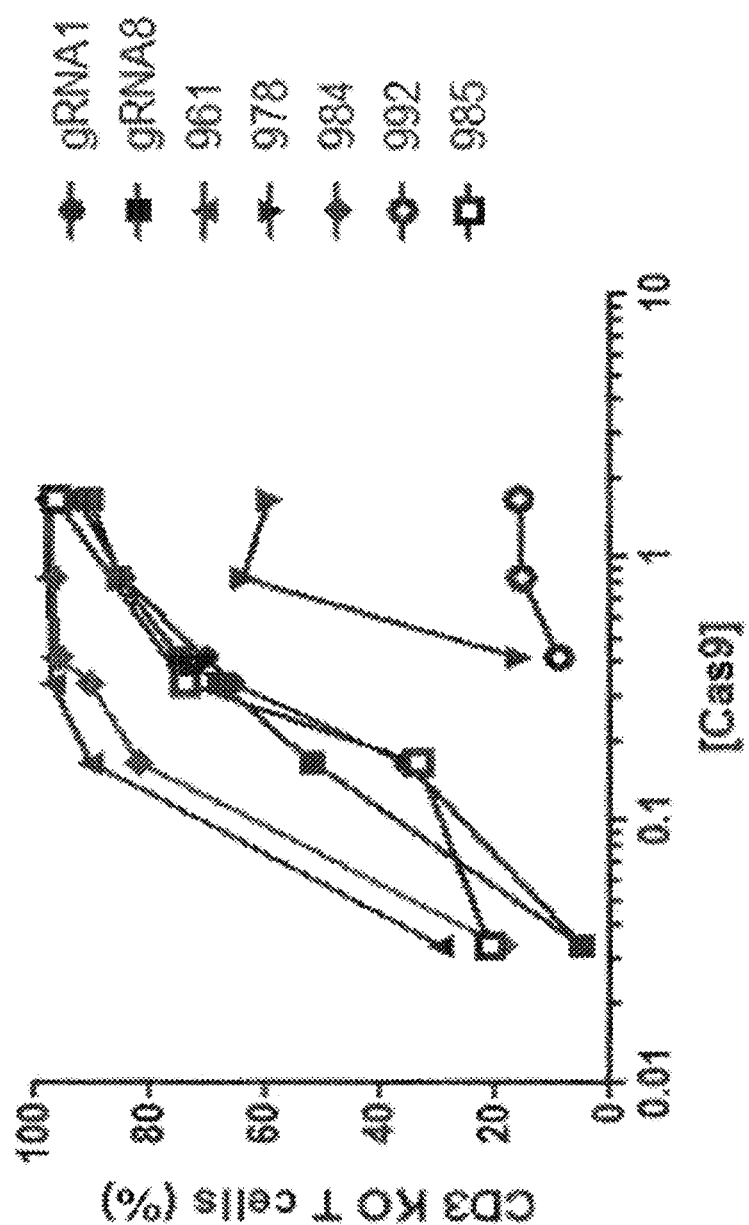
FIGS. 33A and 33B: Evaluation of TRAC targeting gRNAs for effects on cell surface TCR expression. 33A shows loss of CD3 staining is shown for RNPs containing guides CR000961 (961), CR000978 (978), CR000984 (984), CR000992 (992), CR000985 (985), and CR000960 (gRNA1) and CR000979 (gRNA8). 33B shows loss of CD3 staining is shown for RNPs containing guides CR000991 (991), CR000992 (992), CR000993 (993), and CR000978 (978). 991 and 992 are nearly superimposable.
Figure 33B:
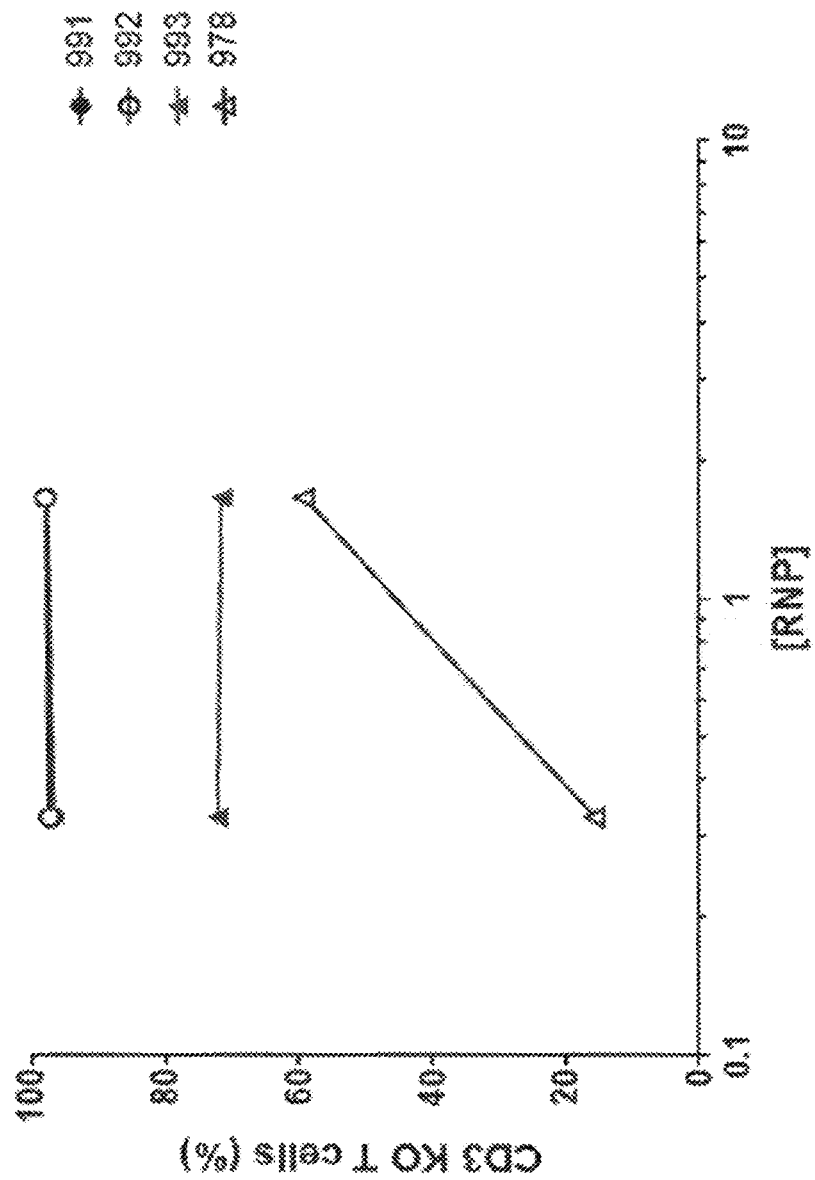

First, gRNAs targeting TRAC were evaluated for effects on cell surface TCR expression at various concentrations of Cas9 (RNP). Human primary T cells were electroporated on day 3 after CD3/CD28 bead activation with RNPs at the indicated concentrations (uM) containing the indicated gRNAs in dual guide format. Additional guide numbers indicate CRxxxxx identifier of targeting domain of the gRNA. Loss of TCR expression was evaluated by staining with anti-CD3 antibody and analysis by flow cytometry 3 days after electroporation (CD3 KO T cells (%). FIG. 33A shows lss of CD3 staining upon electroporation of RNPs containing guides CR000961 (961), CR000978 (978), CR000984 (984), CR000992 (992), CR000985 (985), and CR000960 (gRNA1) and CR000979 (gRNA8). These data show that nearly maximal editing (as shown by loss of CD3 staining) is achieved for RNPs with CR000961 and CR000984-containing gRNAs at RNP concentrations of between 0.2 and 0.3 uM. Other gRNAs achieved maximal editing at concentrations of 1 uM. FIG. 33B shows loss of CD3 staining upon electroporation of RNPs containing guides CR000991 (991), CR000992 (992), CR000993 (993), and CR000978 (978). 991 and 992 are nearly superimposable. Here again, for RNP containing gRNAs 991, 992 and 993, maximum editing was observed at RNP concentrations of 0.3 uM, while gRNA 978% editing continued to increase up to 1.1 uM. As shown in FIG. 33C, electroporate of T cells with gRNA targeting the TRAC locus results in high levels of indel formation at the targeted sites (up to 97% editing) and high levels of frameshift mutations, which are predicted to result in loss of protein expression (up to 78%). Next, the mutations (indels) at each targeted locus were assessed by next generation sequencing. FIG. 34A and FIG. 34B show the top 5 most frequently observed sequence changes for each TRAC targeting dgRNA used for primary human T cell editing. Figures A and B are the outcome from 2 independently performed electroporation experiments. Data are the average from triplicate PCR products. These data show consistent patterns of editing across multiple experiments when the same gRNA format and RNP are used, in with the same delivery technique.

Figure 35:
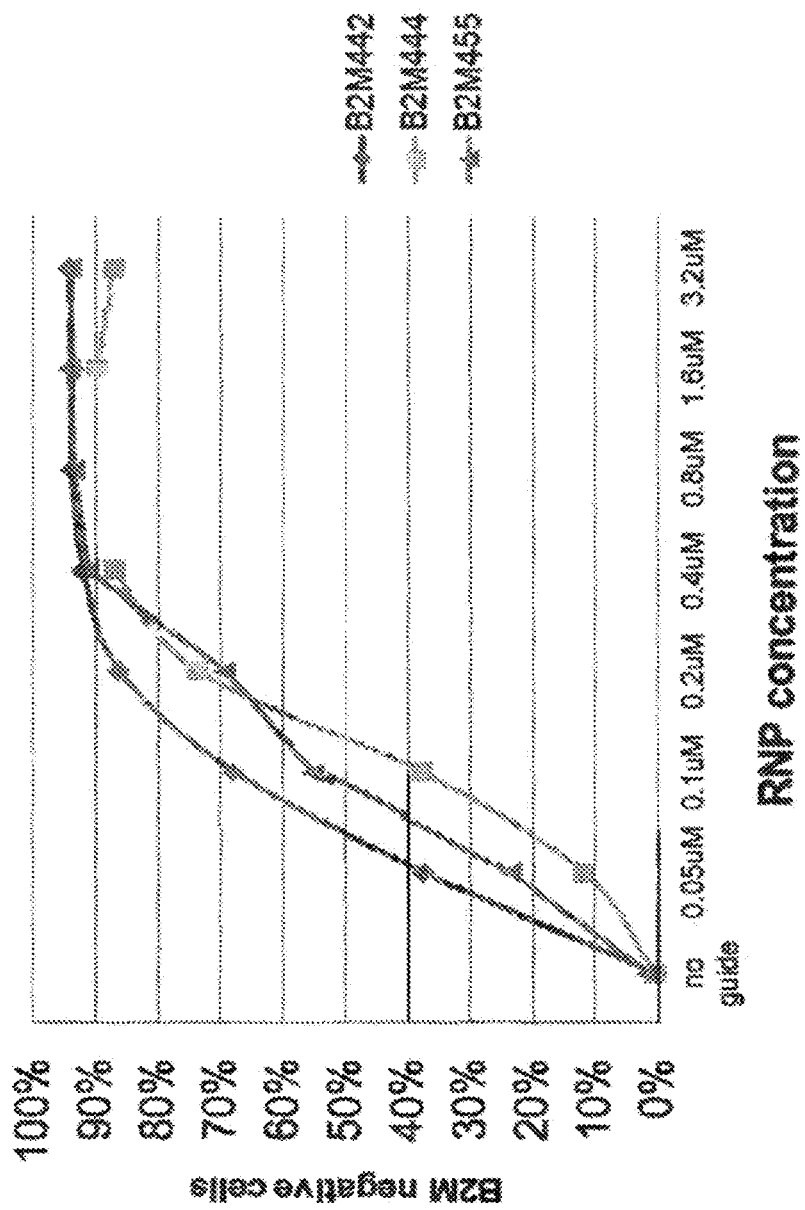
FIG. 35: Evaluation of B2M targeting gRNAs for effects on cell surface B2M expression. Guide numbers indicate CR00xxx identifier of targeting domain.
Figure 36:
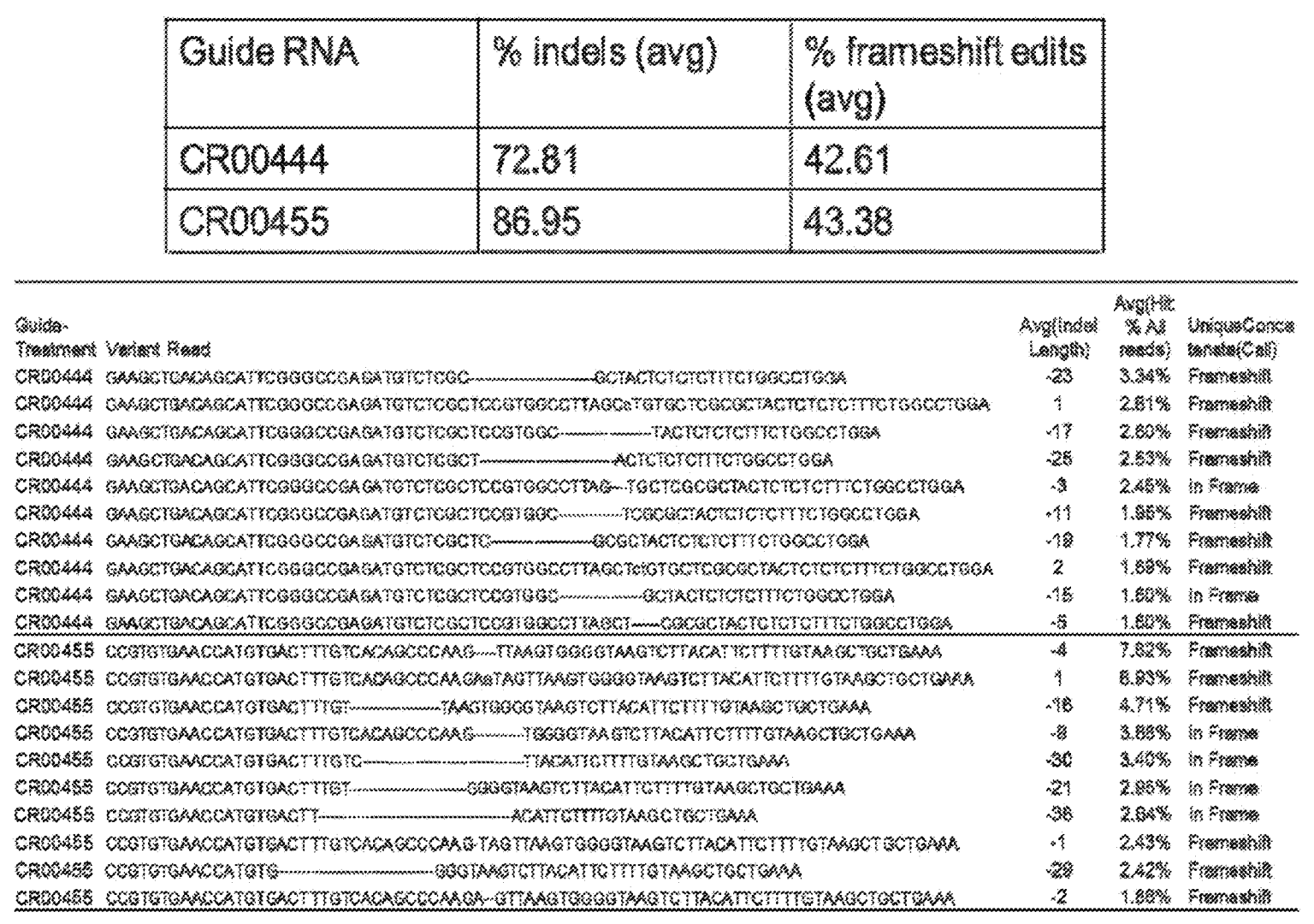

Next, similar experiments were performed with gRNAs (dual guide format) targeting B2M. The effect of RNP concentration was first assessed. Human primary T cells were electroporated on day 2 after CD3/CD28 bead activation with RNPs at the indicated concentrations containing the indicated gRNAs. Guide numbers indicate CR00xxx identifier of targeting domain. Loss of B2M expression was evaluated by staining with anti-B2M antibody and analysis by flow cytometry 4 days after electroporation (B2M negative cells). The results are reported in FIG. 35, and demonstrate that >85% editing (as assayed by loss of B2M surface expression) was achieved by gRNA 442 at 0.2 uM, and at slightly higher RNP concentration (0.4 uM) for gRNA 442 and 455. As shown in FIG. 36, RNPs comprising gRNAs CR000444 and CR000455 result in high levels of editing and high levels of frameshift editing in primary human T cells. Top ten indels produced by each gRNA are shown in the lower panel. Data are the average from triplicate PCR products.

Figure 45:
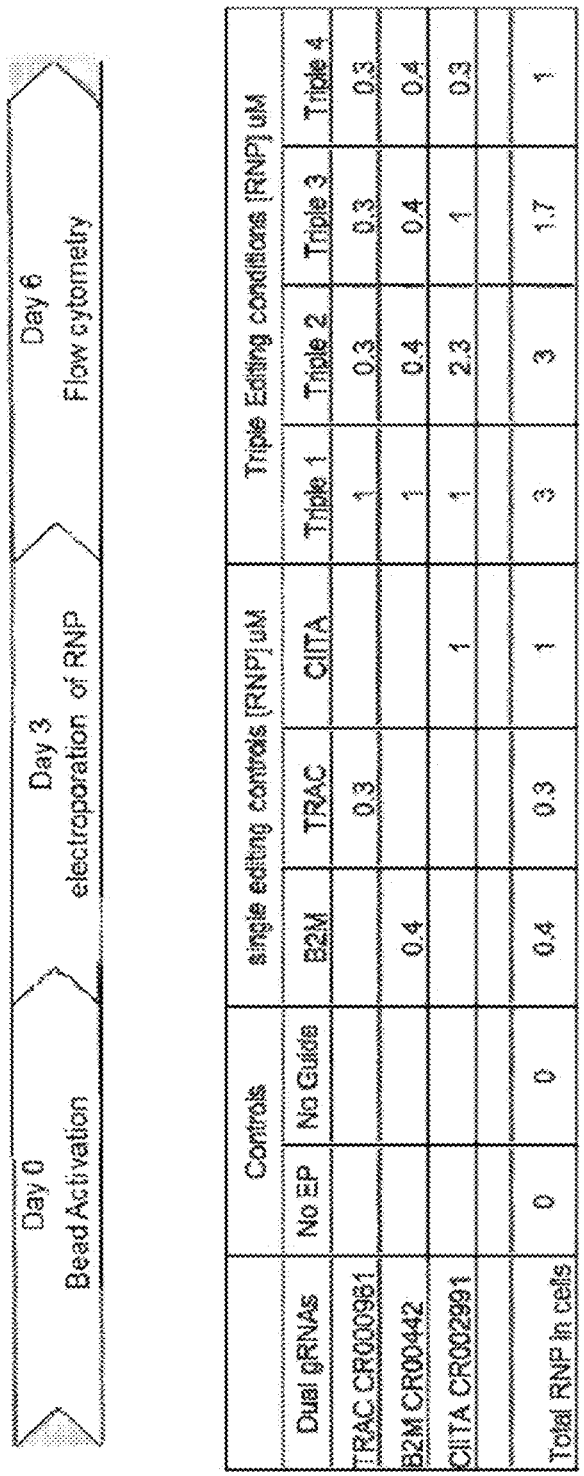
FIG. 45: Schematic protocol for preparation of primary human T cells edited at the B2M, TRAC, and CIITA loci (triple edited cells).
Figure 46:
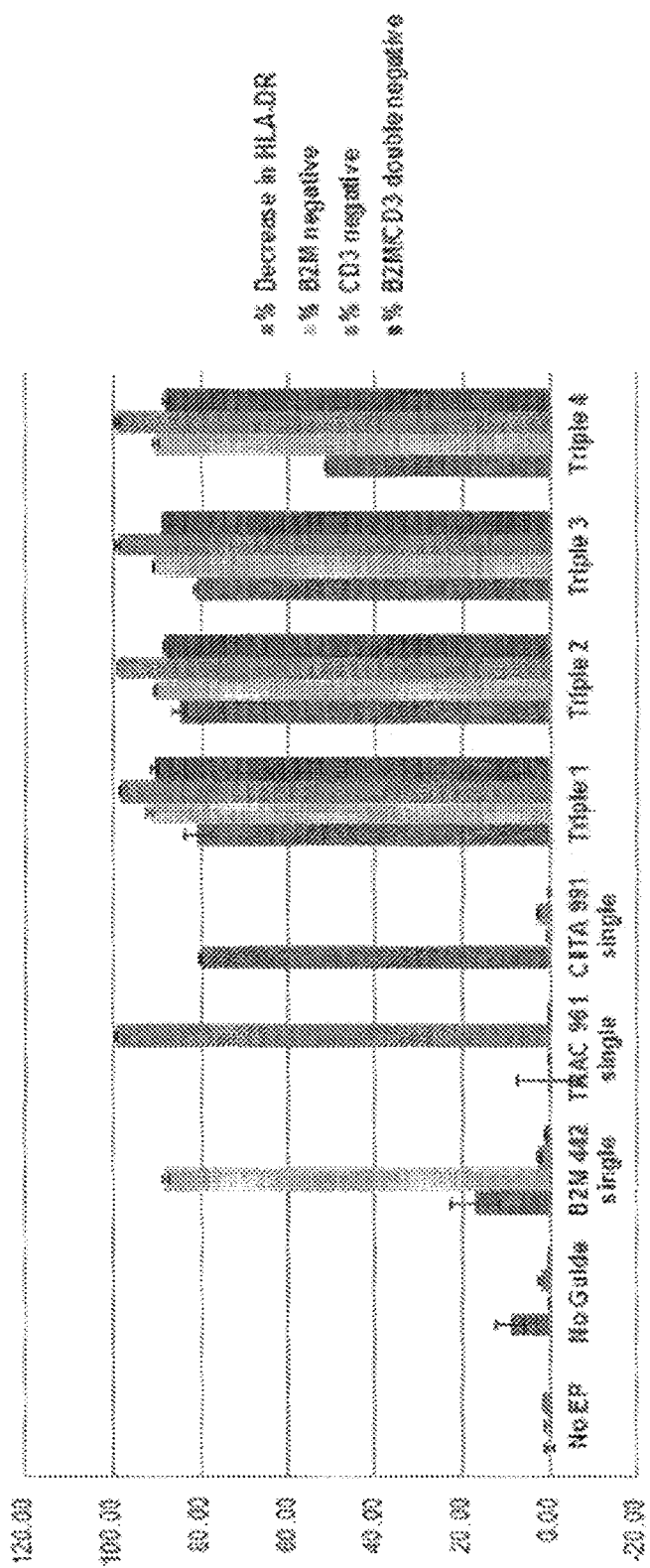
FIG. 46: Evaluation of editing of TRAC, B2M, and CIITA by testing cell surface expression of CD3 epsilon, B2M, and HLA-DR, respectively, by flow cytometry. Cell surface expression was tested in cells that had been electroporated with a single targeting RNP (B2M 442 single, TRAC 961 single, or CIITA 991 single) or with 3 RNPs simultaneously (Triple 1, Triple 2, Triple 3, Triple 4; according to the details in FIG. 45). Cells without electroporation are indicated as "No EP". Cells electroporated with Cas9 but no guide RNA are indicated as "No Guide".
Figure 48:
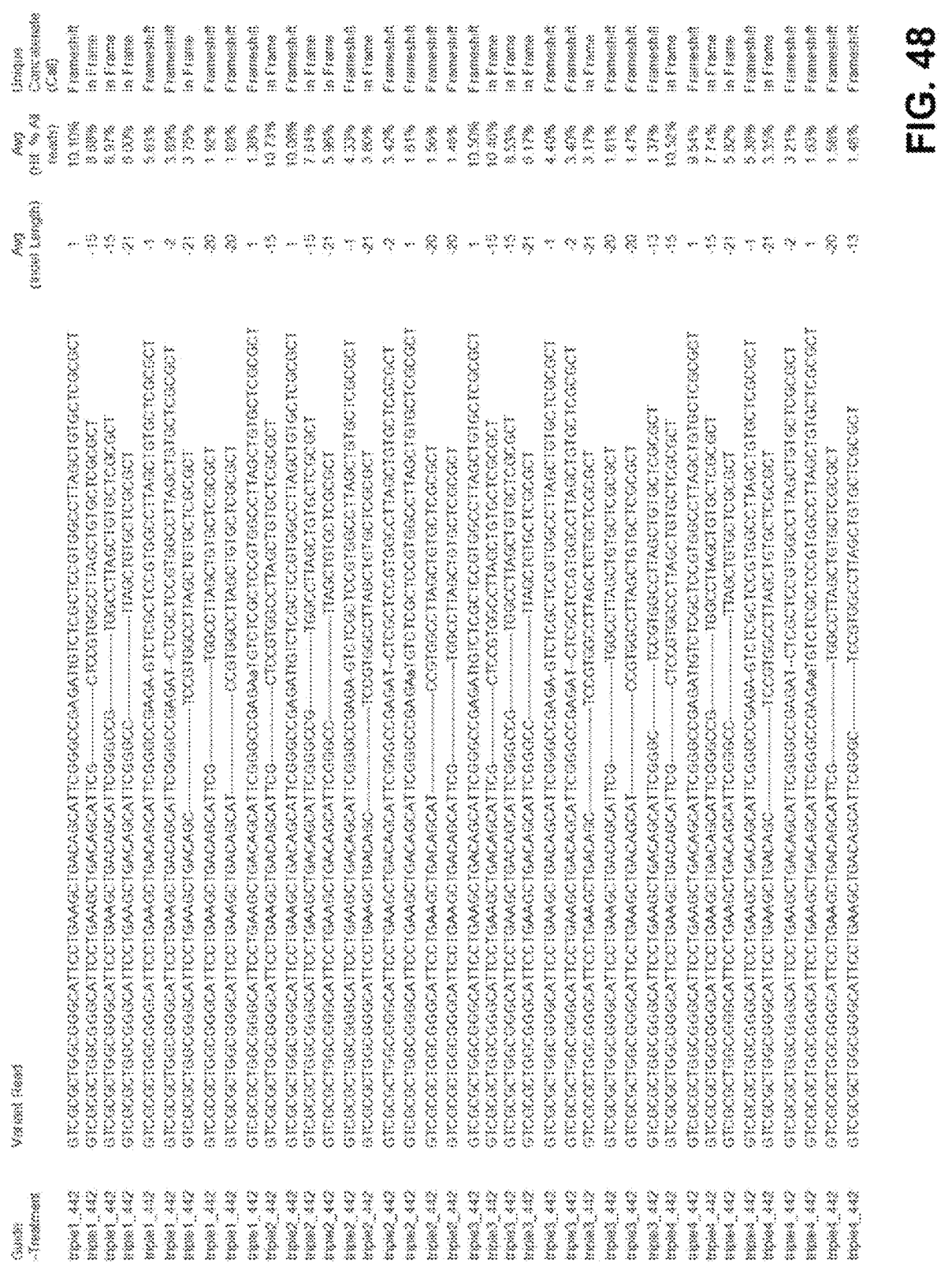
Figure 49:
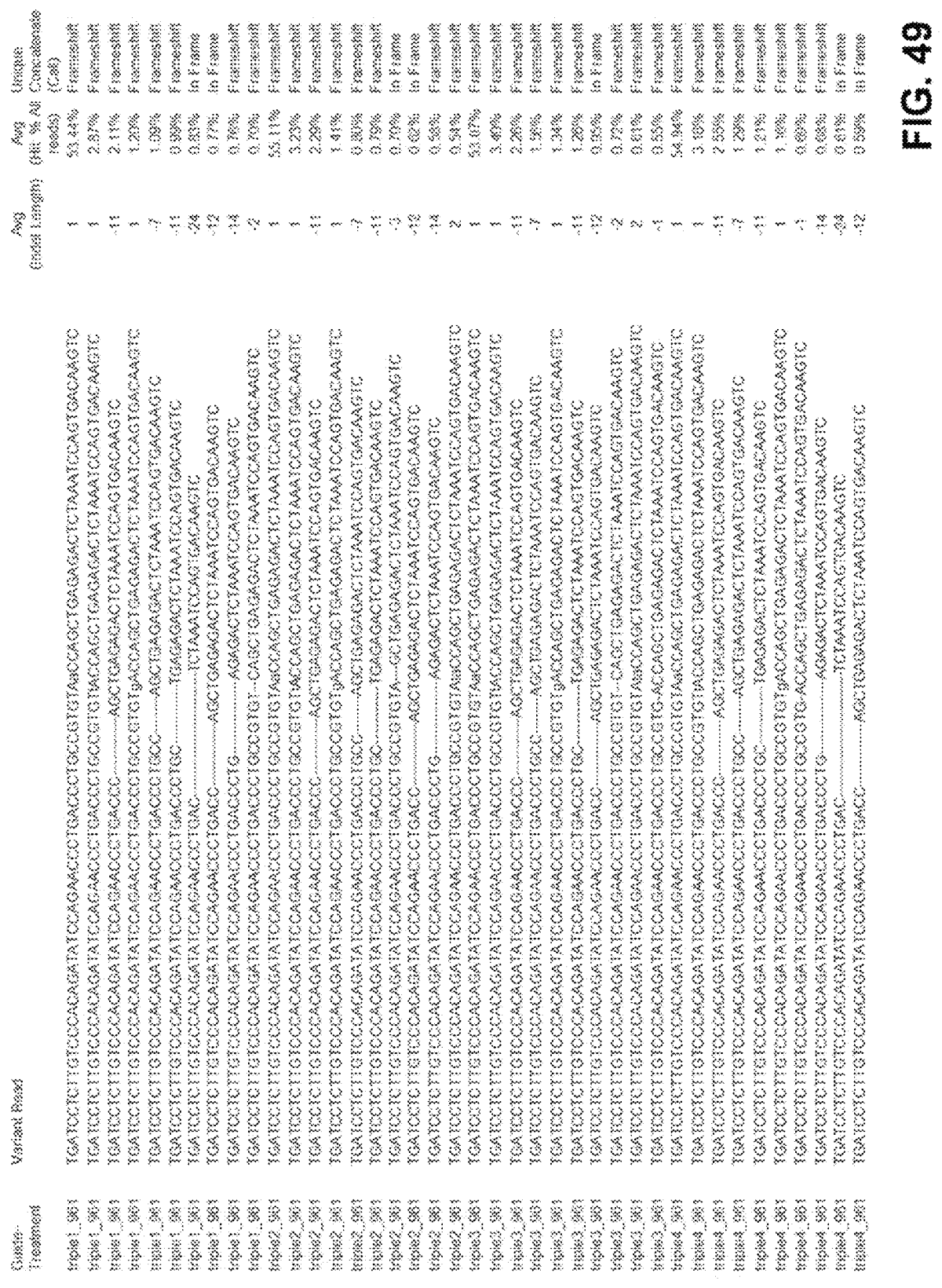
Figure 50:
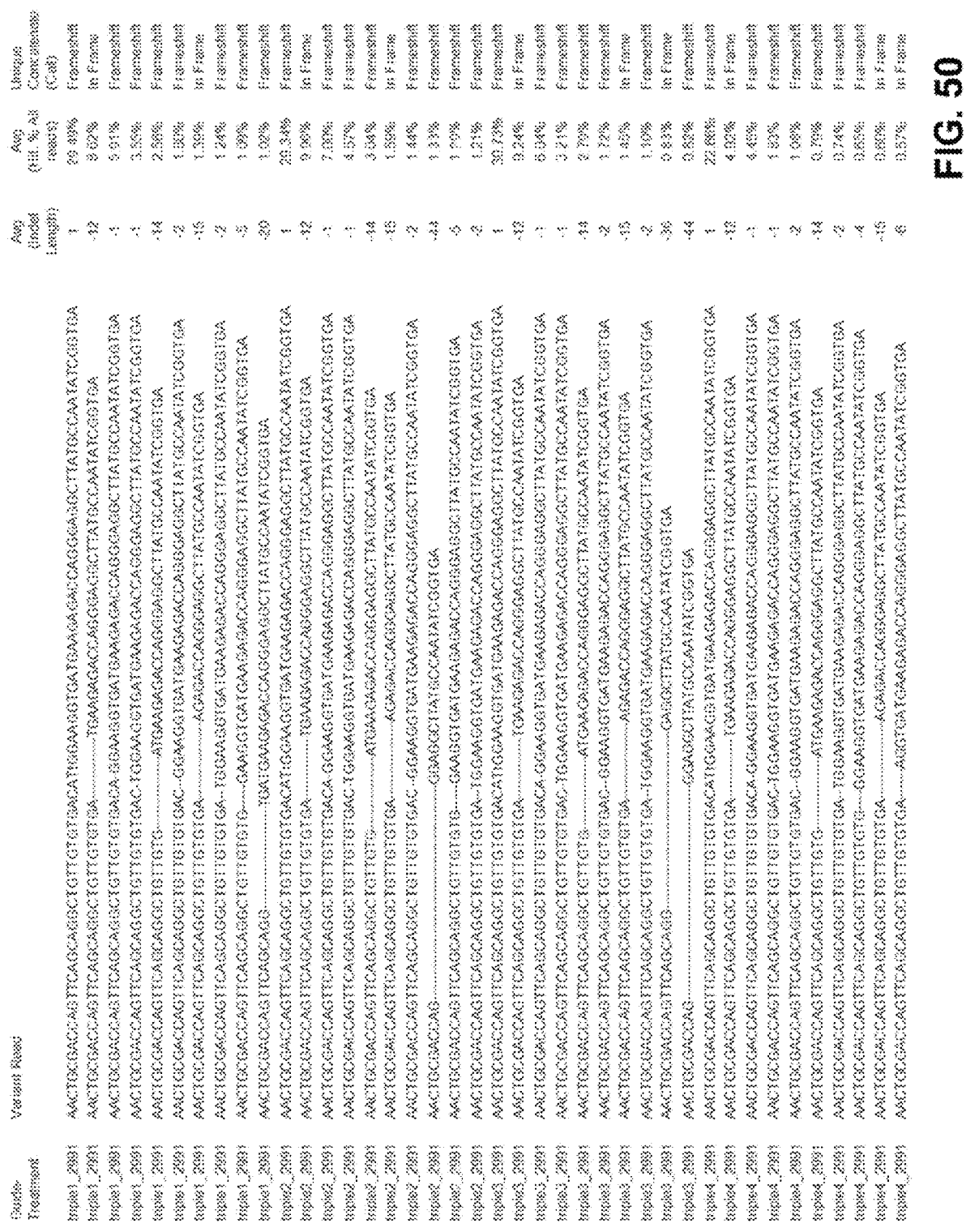

Next, the simultaneous editing of TCR, B2M and CIITA was performed in CART cells, and the function of such CART cells was assessed. FIG. 45 shows the schematic protocol that was followed for these experiments for preparation of primary human T cells edited at the B2M, TRAC, and CIITA loci (triple edited cells). FIG. 46 shows the % loss of cell surface expression of CD3 epsilon, B2M, and HLA-DR, respectively, by flow cytometry (as indicators of editing at TRAC, B2M and CIITA, respectively). As expected, cells electroporated with only single gRNA showed loss of only the expected protein. In cells treated with 3 RNPs, each containing a gRNA to a different target, cells from each population exhibited over 80% loss of each of the target proteins, as well as >80% loss of both B2M and TRAC, with the exception of the lowest concentration of the CIITA-targeting gRNA (triple 4), which resulted in a lower loss of HLA-DR than when higher concentrations of this RNP are delivered to the cells. FIG. 47 shows the genomic editing of the B2M, TRAC, and CIITA loci resulting from human primary T cell simultaneous electroporation with 3 RNPs containing gRNAs targeting the B2M, TRAC, and CIITA loci. The frequency of insertions or deletions is indicated (% indels) and the percentage of these edits that result in frameshifting of the coding sequence is shown in parentheses). FIG. 48, FIG. 49 and FIG. 50 show the top 10 most frequently observed sequence changes at the B2M locus (in response to gRNA comprising CR000442), the TRAC locus (in response to gRNA comprising CR000961) and at the CIITA locus (in response to gRNA comprising CR002991), respectively, in primary human T cells in the context of simultaneous editing of 3 loci (triple editing) with different concentrations of each RNP as shown in the schematic in FIG. 45. These data indicate that the efficient gRNA molecules used here efficiently knock out TRAC, CIITA and B2M in primary human T cells to with high efficiencies, and result in T cells which have reduced graft versus host disease capability (via loss of TCR) and reduced host versus graft disease capability (through loss of both B2M and CIITA), representing an important step toward an allogenic, off-the-shelf T cell product.

Figure 51:
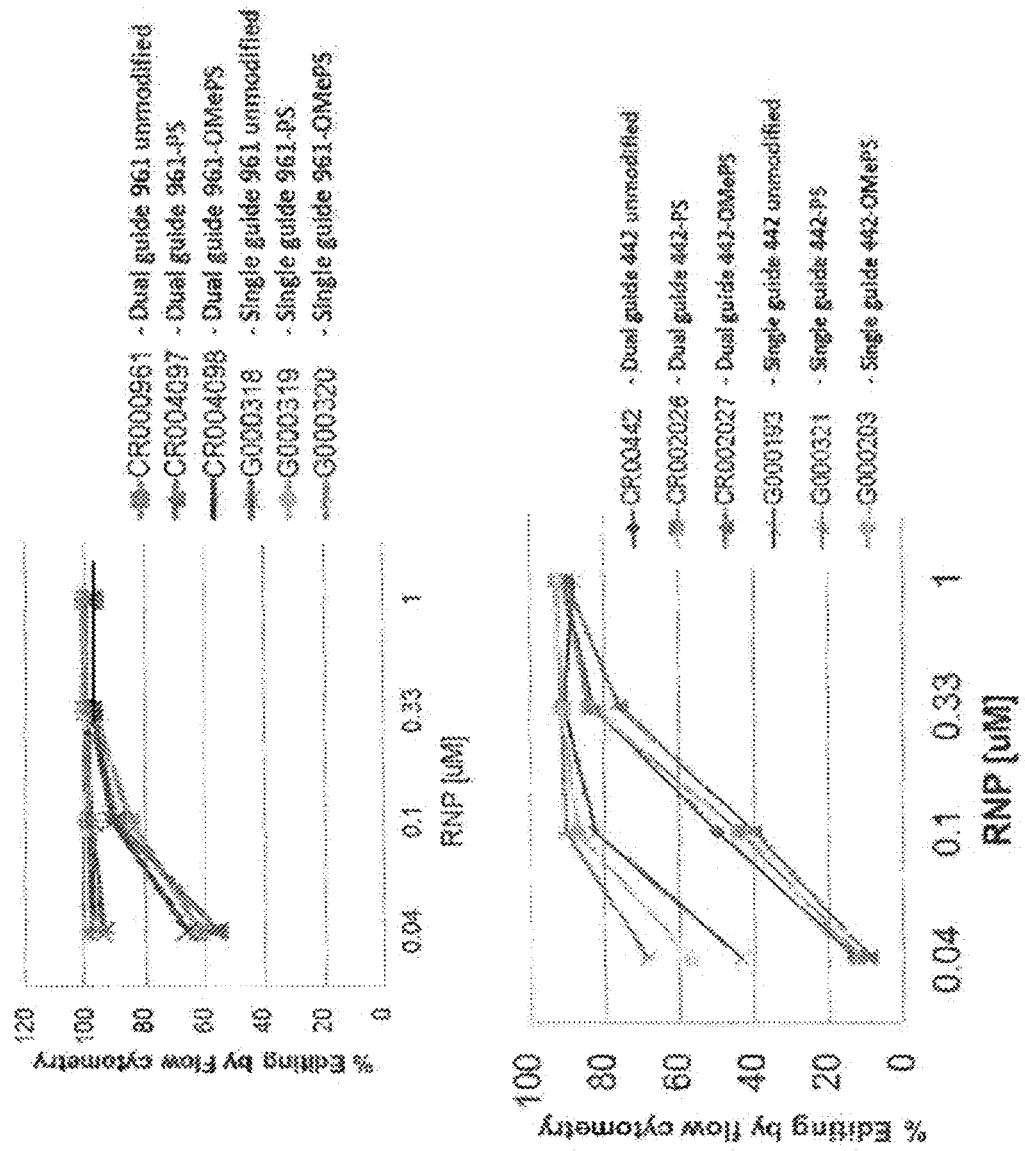
FIG. 51: The format of the guide RNA was evaluated for efficiency of editing. Guide RNAs against TRAC (CR000961; upper panel) or B2M (CR00442; lower panel) were synthesized in the single guide or dual guide format with or without the indicated chemical modifications (PS or OMePS). RNPs were electroporated into human primary T cells at the indicated concentrations. Editing efficiency was evaluated by analysis of cell surface staining of CD3 epsilon for TRAC editing (upper) and B2M protein for B2M editing (lower) by flow cytometry.

Next, the effects of the format of the gRNA molecule was assessed. Guide RNAs against TRAC (comprising the targeting domain of CR000961; upper panel) or B2M (comprising the targeting domain of CR00442; lower panel) were synthesized in the single guide or dual guide format with or without the indicated chemical modifications (PS (3 nt at both 5' and 3' ends are phosphorothioate) or OMePS (3 nt at both 5' and 3' ends are 2'-OMe and phosphorothioate); for dual guide RNA, both the crRNA and the tracr RNA comprised the modifications). RNPs were electroporated into human primary T cells at the indicated concentrations. FIG. 51 shows the results of these experiments: editing efficiency was evaluated by analysis of cell surface staining of CD3 epsilon for TRAC editing (upper) and B2M protein for B2M editing (lower) by flow cytometry. As shown in FIG. 51, all formats were capable of achieving high efficiency editing at RNP concentration of 1 uM, however, sgRNA format was able to maintain high editing efficiencies at lower concentrations than dgRNA formats (down to 0.04 uM for gRNAs comprising the targeting domain of CR000961, and down to 0.1 uM for gRNAs comprising the targeting domain of CR000442). For the TRAC-targeting gRNA, chemical modification had no effect on editing efficiency at the rNP concentrations tested. For the B2M-targeting gRNA, chemical modification of the sgRNAs had an effect on editing efficiency at the lowest concentration tested, with the PS-modified sgRNA having the highest editing efficiency at 0.04 uM RNP concentration.

Example 13: T Cell Resistance to Immunosuppression after Genome Editing of FKBP1A, and Functional Assessment of TCR−/FKBP12− CART Cells Without being bound by theory, as described herein, it is believed that another strategy for generating off-the-shelf ("universal") CART cells is to reduce or eliminate expression of TCR (to, e.g., reduce or suppress graft versus host disease), and also to reduce or eliminate expression of a target of an immunosuppressive agent (e.g., an mTor inhibitor). Subsequent treatment of a patient with such genome edited CART cells in combination with said immunosuppressive agent will inhibit the host immune response (e.g., thereby inhibiting host versus graft responses) without inhibiting the function of the CART cell (e.g., the antitumor function of the CART cell). Towards that end, function of T cells edited to make them TCR− and FKBP12− were assayed, including in the presence of the mTor inhibitor RAD001.

Methods:

After thawing, isolated human T cells were activated with CD3/CD28 beads for 3 days at a bead to cell ratio of 3:1. Cells were then electroporated with RNP containing dual guide RNA molecules (as indicated, as described above in these examples), and Cas9 protein using the Neon instrument with the 100 ul tip kit. RNPs were prepared in the following manner. crRNA and trRNA (10 ul of each at 100 uM) were heated in separate tubes to 95 degrees C. for two minutes and then cooled for 5 minutes at room temperature. Cas9 protein (1.5 mg/ml), 20 uM trRNA, and 20 uM crRNA and 17 ul of buffer (20 mM Tris, PH8.0, 200 nM KCl, 10 mM MgCl2) were combined in a total of 50 ul volume and incubated at 37 degrees for 10 minutes. The RNP was then mixed with 100 ul of cells at a cell count of 2 million cells per ml of T buffer (Invitrogen; Cat #: MPK1096). 100 ul of cells mixed with RNP was transferred to the Neon pipette tip and electroporated at 1600V, 10 ms, 3 pulses. The RNP was at a final concentration of 3.3 uM as a measure of Cas9 protein.

After electroporation, cells were then transferred into a 6-well plate with 2 ml of T cell media with beads at a 3:1 bead to cell ratio. Fresh media was added every other day. On day 4 after electroporation, cells were debeaded and re-plated at a density of 0.5 million per well in a 96-well plate with 100 ul of media and fresh beads were added at a bead to cell ratio of 1:1 for 2 hours. To determine the functional effects of FKBP1A editing, cells were then treated with or without 2.5 nM RAD001 (as indicated) for 3 hours. The phosphorylation of S6 was detected by flow cytometry, and was used as an indication of immunosuppressing by RAD001. For preparation of samples for flow cytometry, cells were spun down and washed with FACS buffer (MACS running buffer+0.5% sBSA), the stained with Dead/live stain (Zombie violet fixable viability kit, Biolegend, Catalog #423114) for 10 minutes. Cells were then washed with FACS buffer and fixed overnight with Cytofix/Cytoperm solution (Becton Dickenson, Catalog #554714). Cells were then washed twice with PBS and permeabilized with Cytofix/Cytoperm solution (Becton Dickenson, Catalog #554714) for 20 minutes. Cells were then washed twice with PBS and incubated with PE conjugated anti-phospho-S6 antibody (phospho-S6 ribosomal protein Ser240/244 (D68F8) Rabbit mAb, Cell Signaling Technologies, Catalog #14236) for 1 hour at 4 degrees. Cells were then washed twice with PBS and analyzed by flow cytometry on the Becton Dickenson LSR Fortessa using FloJo-V10 software.

Figure 54A:
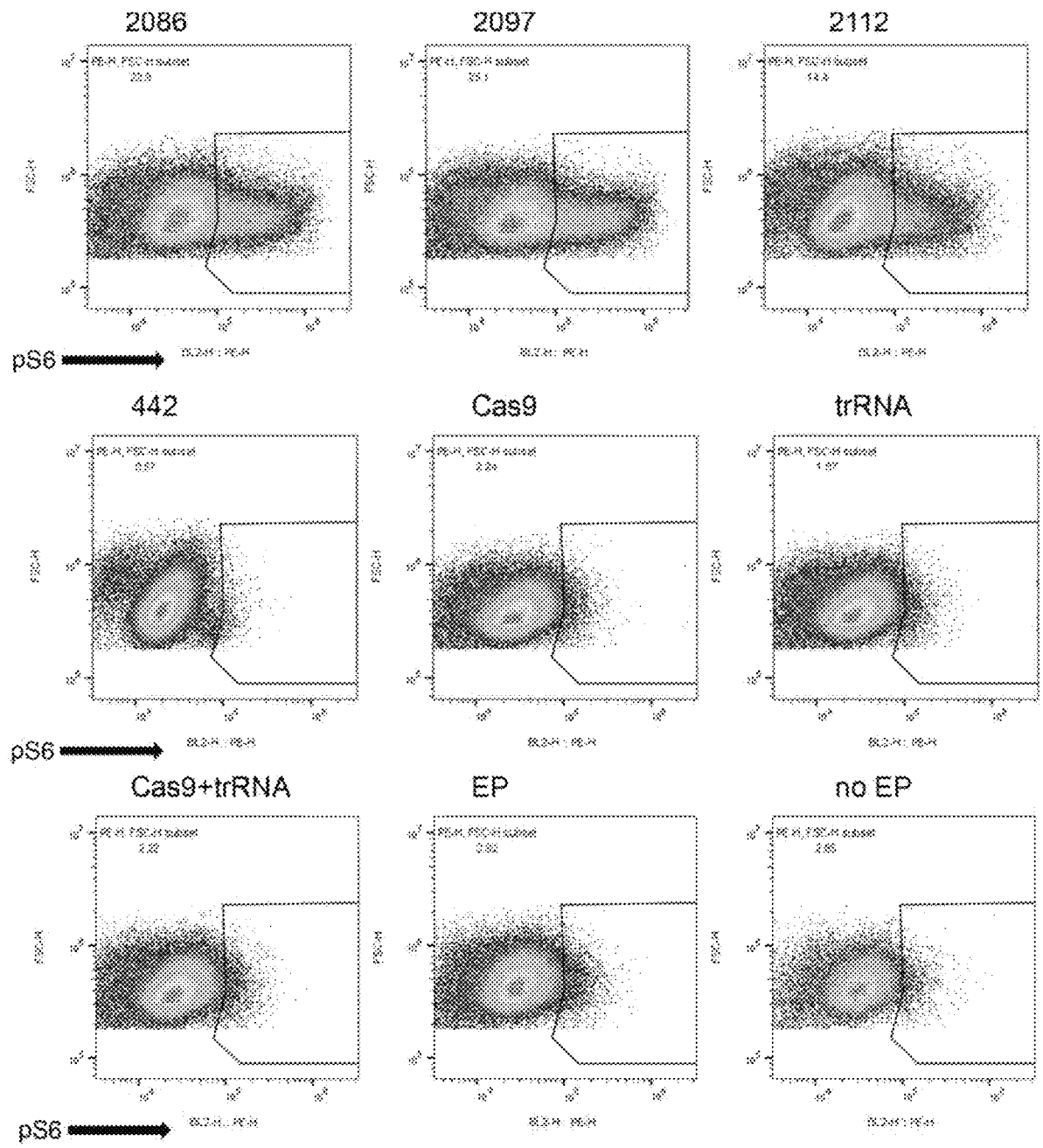
FIG. 54: T cells were edited with RNPs containing gRNAs comprising targeting domains to FKBP1A (CR002086, CR002097, CR002122; indicated as 2086, 2097, and 2112, respectively) or with negative controls: 442 (an irrelevant guide CR00442 targeting B2M); Cas9 (Cas9 alone with no trRNA or crRNA); trRNA (tracer RNA, but no crRNA or Cas9 protein); Cas9+trRNA (Cas9 and tracer RNA but no crRNA); EP (cells only with electroporation); no EP (cells only with no electroporation). After electroporation cells were treated with 2.5 nM RAD001 (FIG. 54A) or left untreated (FIG. 54B) and the impact on mTOR pathway inhibition was evaluated by analyzing S6 phosphorylation (pS6) by flow cytometry. The Y-axis indicates forward scatter (FSC) and the X-axis indicates the level of pS6. Positive staining for pS6 (shown in the gating trace) was determined by gating above the fluorescence level seen in a control stained with isotype antibody (not shown). Quantitation of S6 phosphorylation from the flow cytometry data is shown in the graph in the lower panel (FIG. 54C).
Figure 54B:
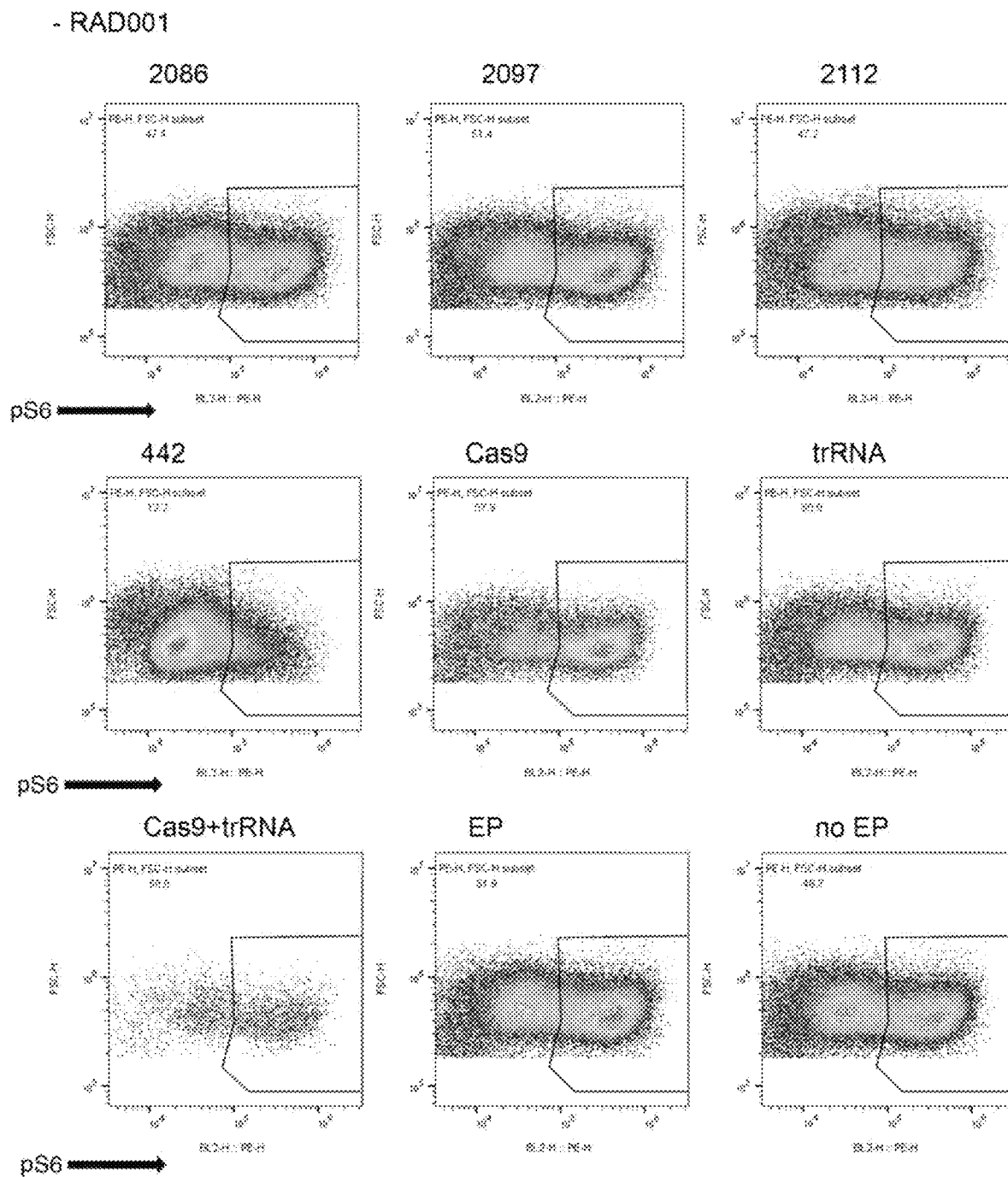
Figure 54C:
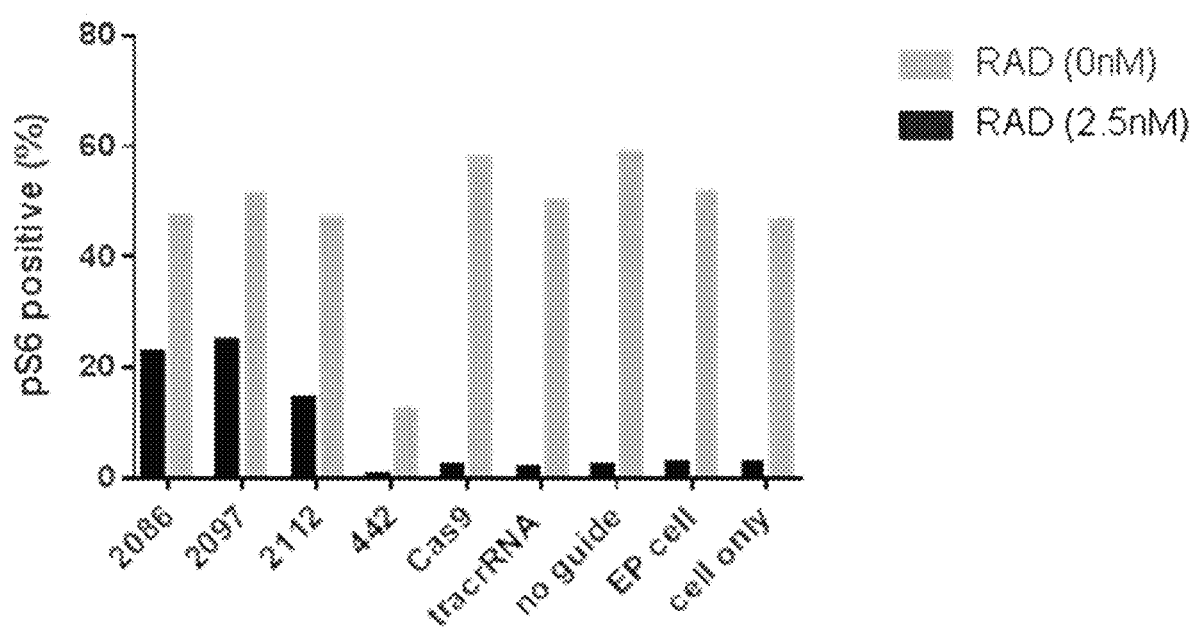

FIG. 54 shows the results of S6 phosphorylation in the presence or absence of mTor inhibitor RAD001 after exposure to gRNA targeted towards FKBP1A. T cells were edited with RNPs containing guide sequences targeting FKBP1A (CR002086, CR002097, CR002122; indicated as 2086, 2097, and 2112, respectively) or with negative controls: 442 (an irrelevant guide CR00442 targeting B2M); Cas9 (Cas9 alone with no trRNA or crRNA); trRNA (tracer RNA, but no crRNA or Cas9 protein); Cas9+trRNA (Cas9 and tracer RNA but no crRNA); EP (cells only with electroporation); no EP (cells only with no electroporation). After electroporation cells were treated with 2.5 nM RAD001 (upper panel) or left untreated (lower panel) and the impact on mTOR pathway inhibition was evaluated by analyzing S6 phosphorylation (pS6) by flow cytometry. The Y-axis indicates forward scatter (FSC) and the X-axis indicates the level of pS6. Positive staining for pS6 (shown in the gating trace) was determined by gating above the fluorescence level seen in a control stained with isotype antibody (not shown). Quantitation of S6 phosphorylation from the flow cytometry data is shown in the graph in the lower panel. These data demonstrate that editing of FKBP1A (and subsequence loss of FKBP12 protein) renders primary T cells refractory to the inhibitory effects of the rapalog RAD001.

Next, CART cells were generated which are TCR negative and FKBP12 negative, and their function evaluated. Briefly, PBMC were isolated from human blood by using centrifugation method using Ficoll. Total T cells were isolated from these PBMC's using human Pan T Cell Isolation Kit (Miltenyi Biotec #130-096-535). These cells were aliquoted and frozen. These frozen cell aliquots were then thawed and activated using CD3/CD28 beads (DynaBeads Invitrogen Cat #111.41D) at bead to cell ratio of 3:1. Day 1 post activation, CAR BCMA-10 or CAR-CD19 (CTL019) virus was used to transduce these cells at MOI of 5. UTD (untransduced cells) were not treated with virus. Day 4 post activation, either CAR BCMA-10 or CAR-CD19 or untransduced T cells were then electroporated with RNP with the indicated guide RNAs or without guide RNA (no guide) as indicated using Neon electroporator. RNP were prepared as described above. For TRAC editing, CR000961 was used (indicated as 961) alone or with guides targeting FKBP1A as indicated. For FKBP1A editing CR0002097 (indicated as 2097) or CR002097 and CR002086 together (indicated as 2097+2086) was used. The RNP (or RNPs) was then mixed with 100 ul of cells at a cell count of 2 million cells per ml of T buffer (Invitrogen; Cat #: MPK1096). 100 ul of cells mixed with RNP was transferred to the Neon pipette tip and electroporated at 1600V, 10 ms, 3 pulses. The RNP was at a final concentration of 3.3 uM as a measure of Cas9 protein. After electroporation, cells were then transferred into a 6-well plate with 2 ml of T cell media with beads at a 3:1 bead to cell ratio. Fresh media was added every other day. Five days after electroporation, 500,000 cells (for phosphor-S6 staining) or 50,000 cells for cell surface marker staining (eg CD3) were removed from culture and analyzed by flow cytometry (BD Fortessa) using FlowJo software. Expression of TCR was detected by using anti-CD3-PercpCy5.5 (Ebiosciences 45-0037-42). Cell surface expression of CAR was evaluated by staining with Biotinylated Protein L followed by Streptavidin-PE (016-110-084 Jackson Immuno Research). T cells were detected by staining CD4 using anti-CD4-V450 (48-0047-42 Ebiosciences) or CD8 using anti-CD8-APC (17-0087-42 eBiosciences).

To determine the functional effects of FKBP1A editing, on day 4 after electroporation, cells were debeaded and re-plated at a density of 0.5 million per well in a 96-well plate with 100 ul of T cell media and fresh beads were added at a bead to cell ratio of 1:1 for 2 hours. Cells were then treated with or without 2.5 nM RAD001 (as indicated) for 3 hours. The phosphorylation of S6 was detected by flow cytometry. For preparation of samples for flow cytometry, cells were spun down and washed with FACS buffer (MACS running buffer+0.5% sBSA), the stained with Dead/live stain (Zombie violet fixable viability kit, Biolegend, Catalog #423114) for 10 minutes. Cells were then washed with FACS buffer and fixed overnight with Cytofix/Cytoperm solution (Becton Dickenson, Catalog #554714). Cells were then washed twice with PBS and permeabilized with Cytofix/Cytoperm solution (Becton Dickenson, Catalog #554714) for 20 minutes. Cells were then washed twice with PBS and incubated with PE conjugated anti-phospho-S6 antibody (phospho-S6 ribosomal protein Ser240/244 (D68F8) Rabbit mAb, Cell Signaling Technologies, Catalog #14236) for 1 hour at 4 degrees. Cells were then washed twice with PBS and analyzed by flow cytometry on the Becton Dickenson LSR Fortessa using FloJo-V10 software.

To test the cytokine release from edited CART cells, effector cells (edited/unedited CART or untransduced cells) were thawed in media (RPMI, 5% FCS, 10 mM Hepes, 1× Pen/Strep, 1× Glutamine) on the day of the assay and counted on Cellometer (Nexelcom). These cells were then co-cultured with target cells expressing BCMA (KMS11, RPM18226) or cells expressing CD19 (Nalm6) at Effector: Target ratio of 1:1. 100 ul of co-culture supernatant was harvested after 20 hours. These supernatants were then used measure the cytokines IL-2 and IFN-gamma released using Meso Scale Discovery, Proinflammatory Panel 1 catalog #N05049A-1 system according to the manufacturer's protocol.

To measure the cytolytic capacity of effector cells (edited/unedited CART or untransduced cells), cells were thawed in media (RPMI, 5% FCS, 10 mM Hepes, 1× Pen/Strep, 1× Glutamine) on the day of the assay and counted on Cellometer (Nexelcom). These cells were then co-cultured for 20 hours with 30,000 target cells stably expressing the luciferase reporter gene and expressing BCMA (KMS11, RPMI8226) or cells expressing CD19 (Nalm6) at Effector: Target ratio of 1:1 in a 96 well assay plate black with clear bottom (Costar, cat #3904). Luciferase signal was measured using Bright-Glo substrate (Promega, Ref #E263B) on the EnVision multiple plate reader instrument from Perkin Elmer. Cell killing was inferred from the decrease in luciferase signal and was calculated as follows:

$$\text{Target cell killing (\%)}=100-(\text{sample luminescence}/\text{average maximal luminescence})*100$$

For the T cell proliferation assay, cells prepared as above were thawed and co-cultured with target cells expressing BCMA (KMS11, RPMI8226) or cells expressing CD19 (Nalm6). Irradiated target tumor cells were co-cultured with edited or unedited CART cells at an effector to target ratio of 1:1 for 4 days followed sample staining for CD4, CD8, and CAR as above and flow cytometry analysis Becton Dickenson LSR Fortessa and analyzed with FloJo-V10 software. The number of T-cells (stained with anti-CD4-V450 and anti-CD8-APC) was determined by the number of CD4+ plus CD8+ cells relative to 3000 counting beads (Life technology, Catalog #C36950). The number of CAR+ T cells was determined by gating the CAR+ cell population (stained with Biotinylated Protein L followed by Streptavidin-PE).

Figure 55A:
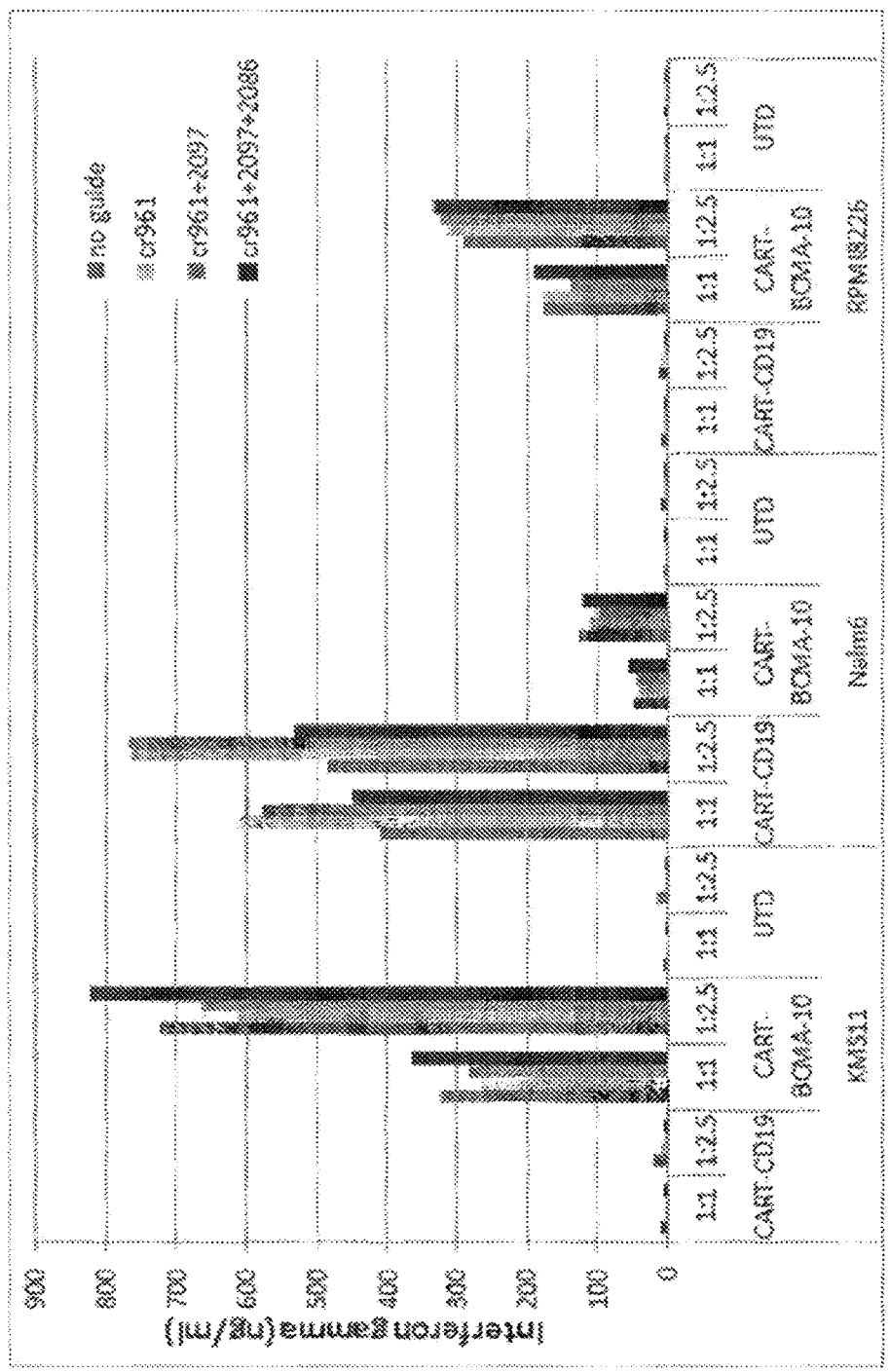
FIGS. 55A and 55B: Cytokine production by edited CART cells in response to antigen exposure. Gene editing was performed on CART cells using the CR000961 guide to target the TRAC locus and/or the CR002097 and CR002086 guides to target the FKBP1A locus (as indicated by cr961, 2097, and 2086, respectively). CART cells electroporated with an RNP containing no guide RNA were prepared as a negative control. CART cells expressing either CART-CD19, CART-BCMA-10, or untransduced (UTD) (as indicated) were mixed with the indicated cancer cell (KMS11 (BCMA positive), Nalm6 (CD19 positive), or RPMI8226 (BCMA positive)) at an effector to target ratio of either 1:1 or 1:2.5 (as indicated). Cell culture supernatants were collected and interferon gamma was measured (Figure A) or IL-2 was measured (Figure B).
Figure 55B:
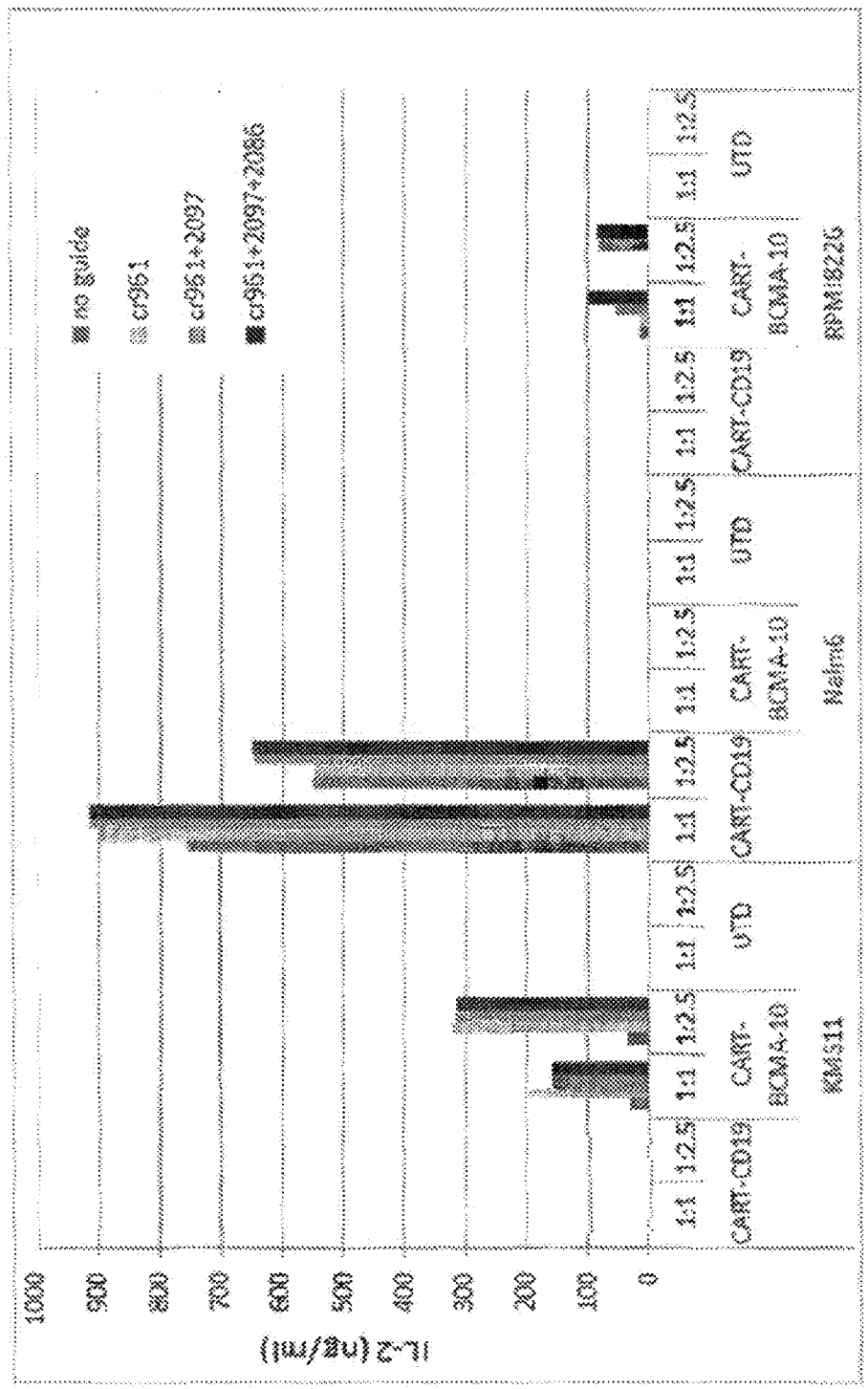
Figure 56:
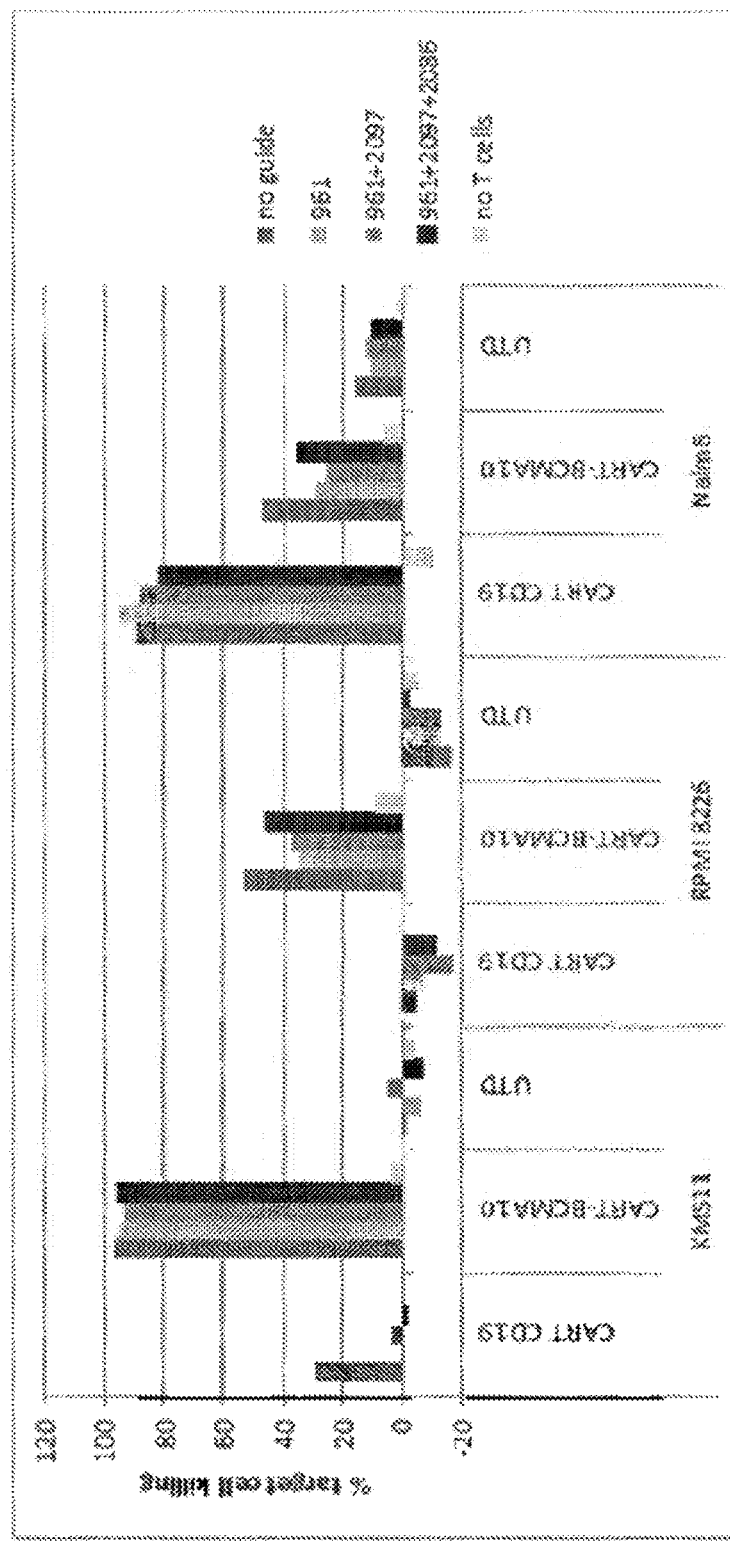
FIG. 56: Killing of antigen positive cancer cell lines by edited CART cells. Gene editing was performed on CART cells using the CR000961 guide to target the TRAC locus and/or the CR002097 and CR002086 guides to target the FKBP1A locus (as indicated by cr961, 2097, and 2086, respectively). CART cells electroporated with an RNP containing no guide RNA were prepared as a negative control. CART cells expressing either CART-CD19, CART-BCMA-10, or untransduced (UTD) (as indicated) were mixed with the indicated cancer cell lines that stable express the luciferase reporter (KMS11 (BCMA positive), Nalm6 (CD19 positive), or RPMI8226 (BCMA positive)) at an effector to target ratio of 1:1. Luciferase signal was measured and cell killing was determined as a loss of luciferase activity.
Figure 57:
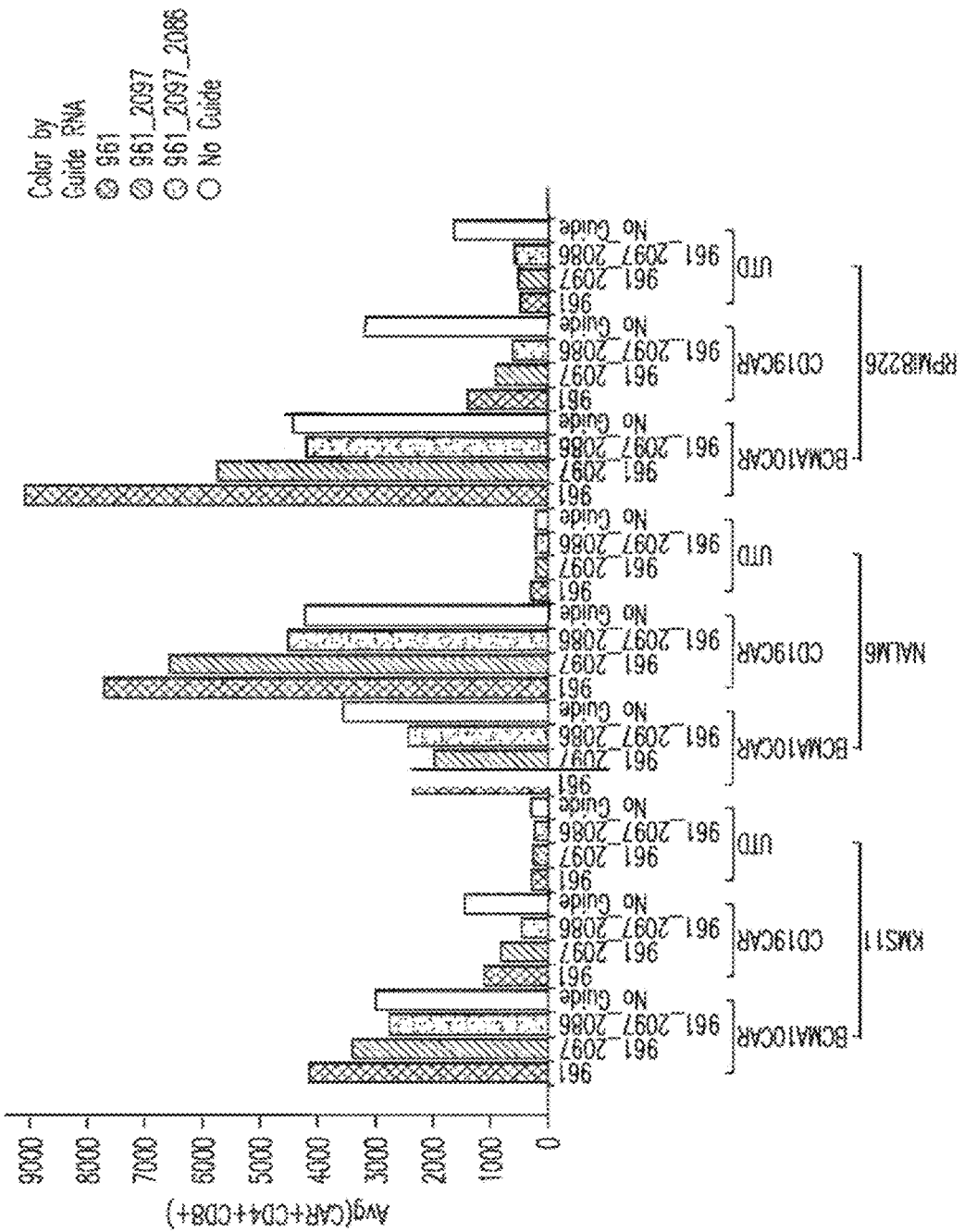
FIG. 57: Proliferation of edited CART cells in response to antigen exposure. Gene editing was performed on CART cells using the CR000961 guide to target the TRAC locus and/or the CR002097 and CR002086 guides to target the FKBP1A locus (as indicated by 961, 2097, and 2086, respectively). CART cells electroporated with an RNP containing no guide RNA were prepared as a negative control. CART cells expressing either CART-CD19 (labeled CD19CAR), CART-BCMA-10 (labeled BCMA10CAR), or untransduced (UTD) (as indicated) were mixed with the indicated cancer cell lines (KMS11 (BCMA positive), Nalm6 (CD19 positive), or RPMI8226 (BCMA positive)) at an effector to target ratio of 1:1. Proliferation was measured by counting the sum of CD4+ and CD8+ cells that are CAR+ relative to a fixed number of counting beads.
Figures 1, 58A:
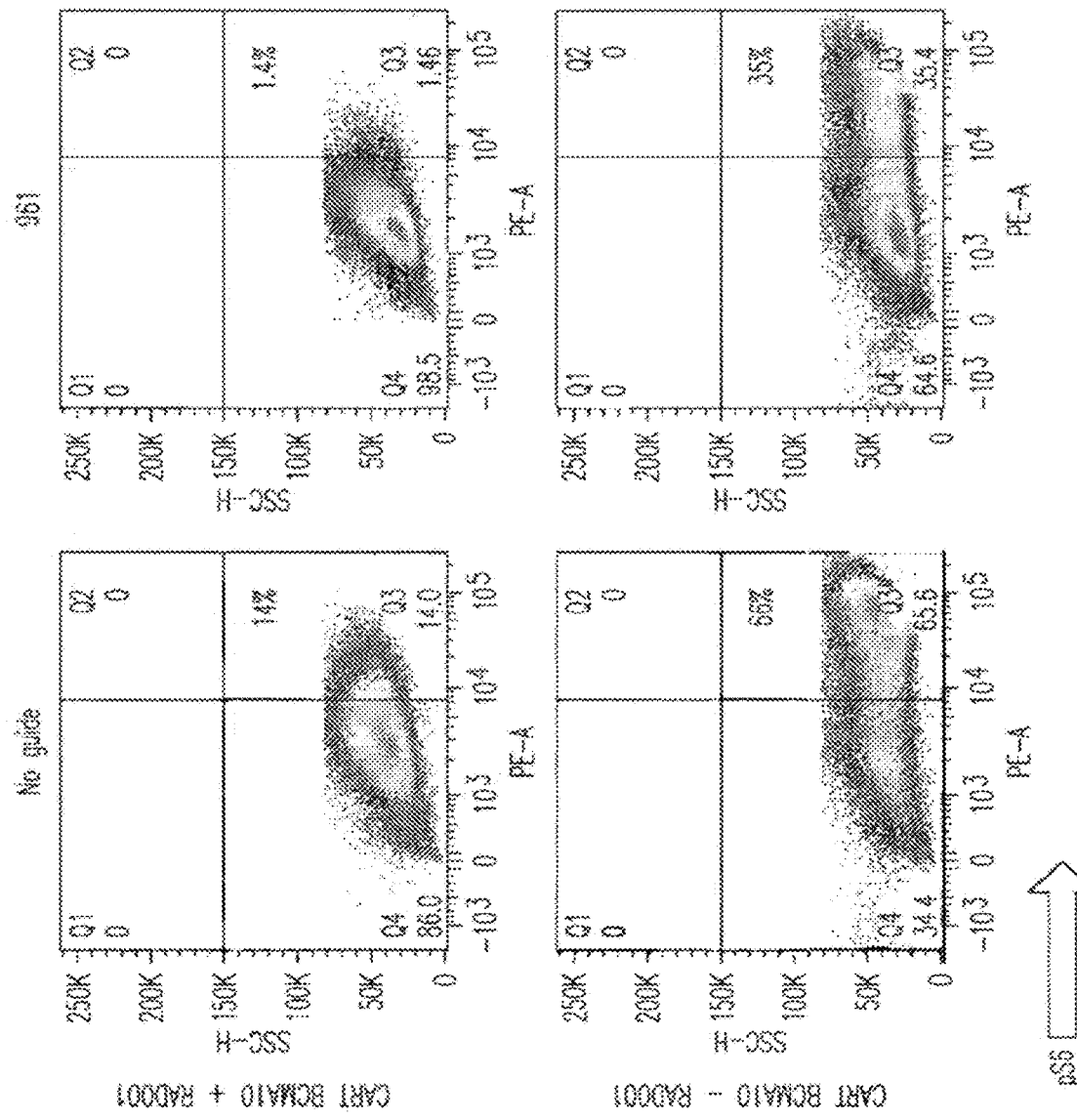
Figures 2, 58A:
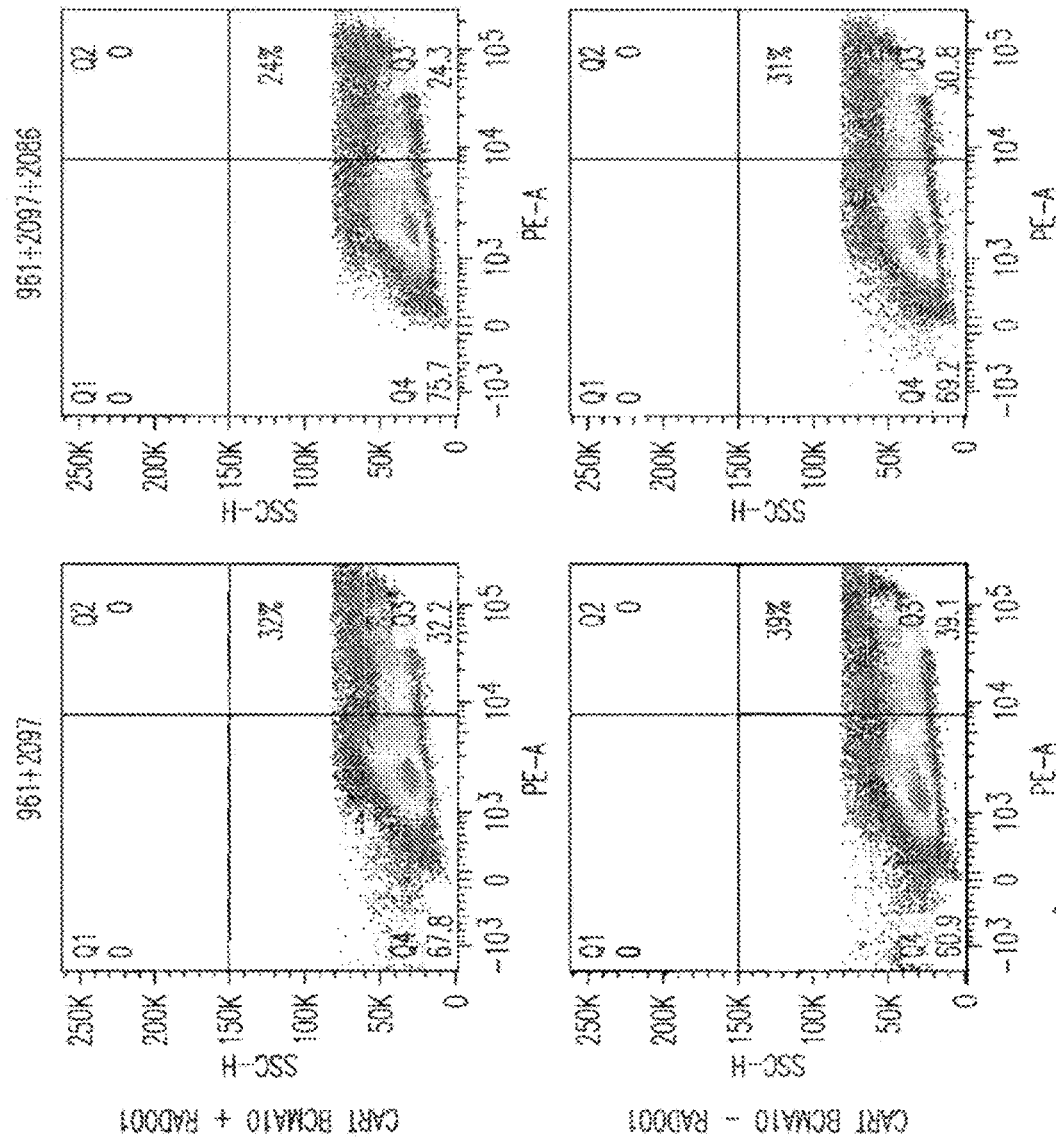
Figures 3, 58A:
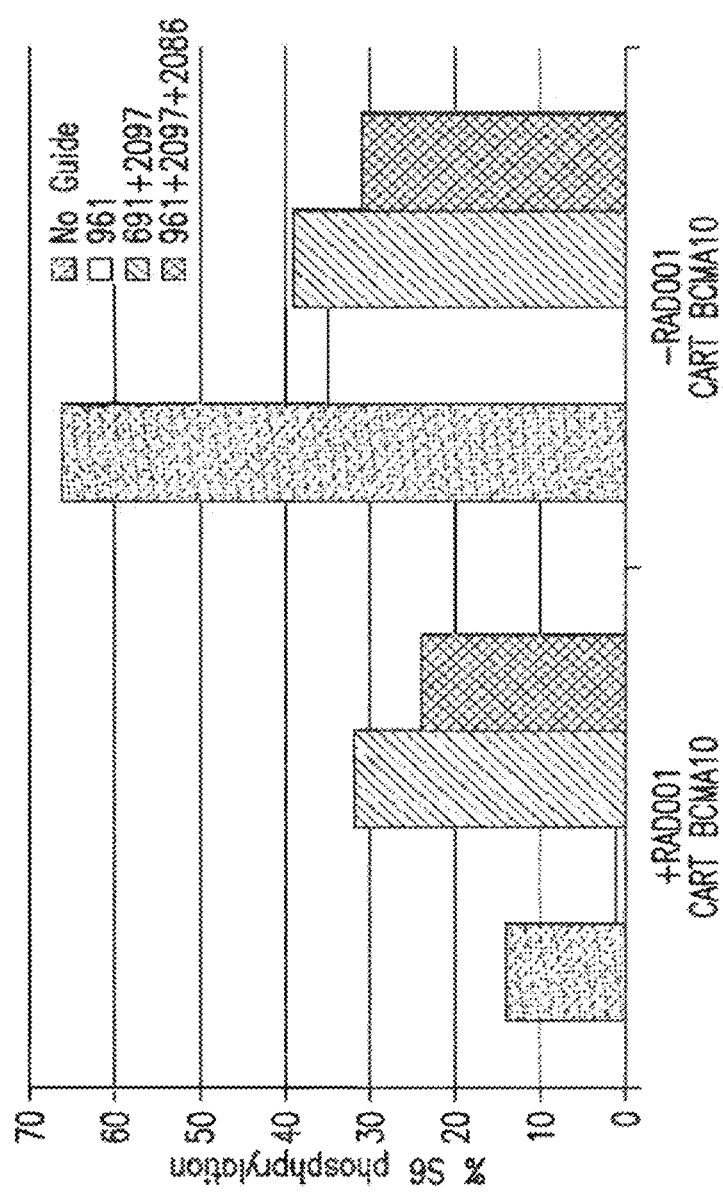
Figures 1, 58B:
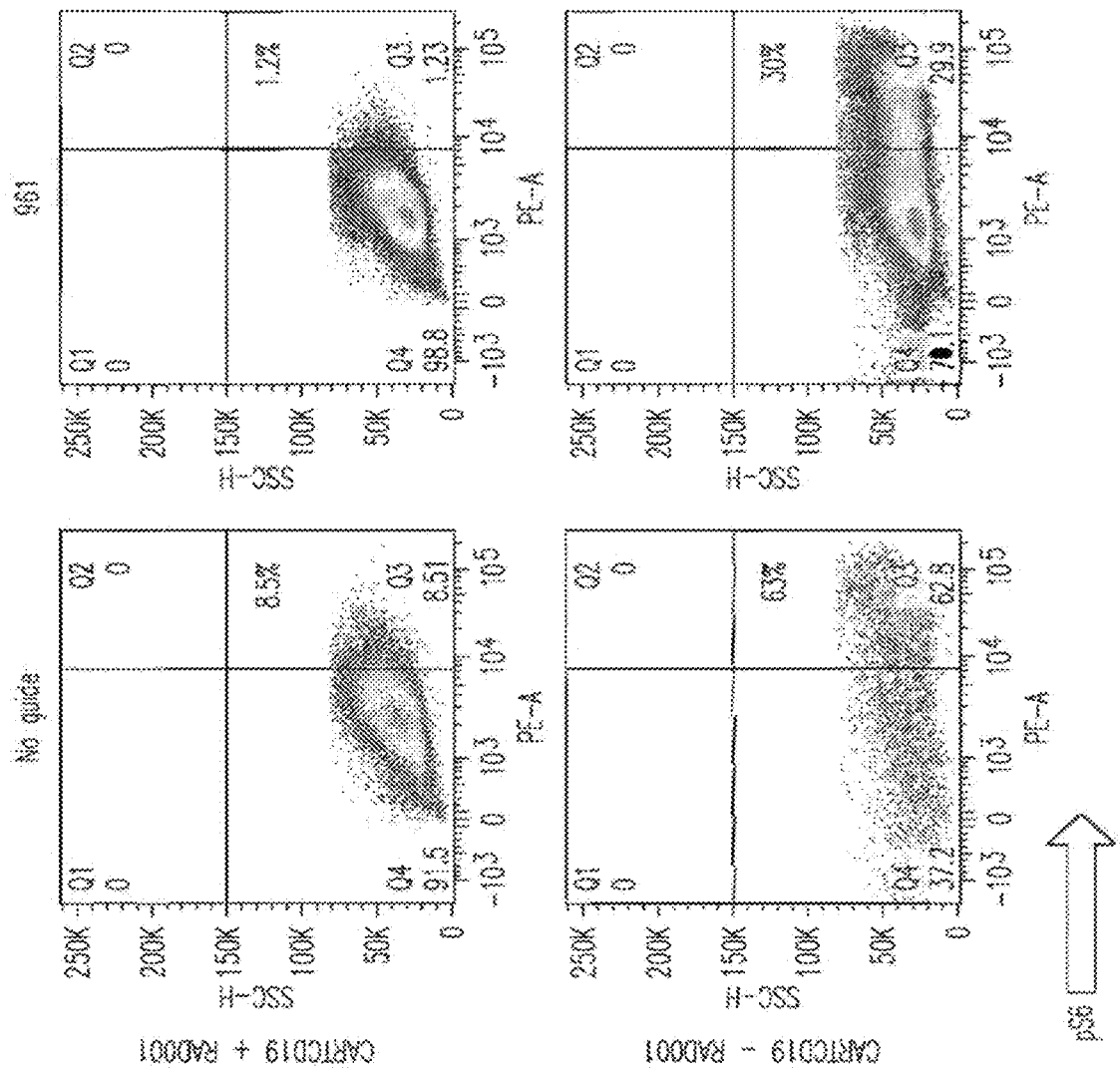
Figures 2, 58B:
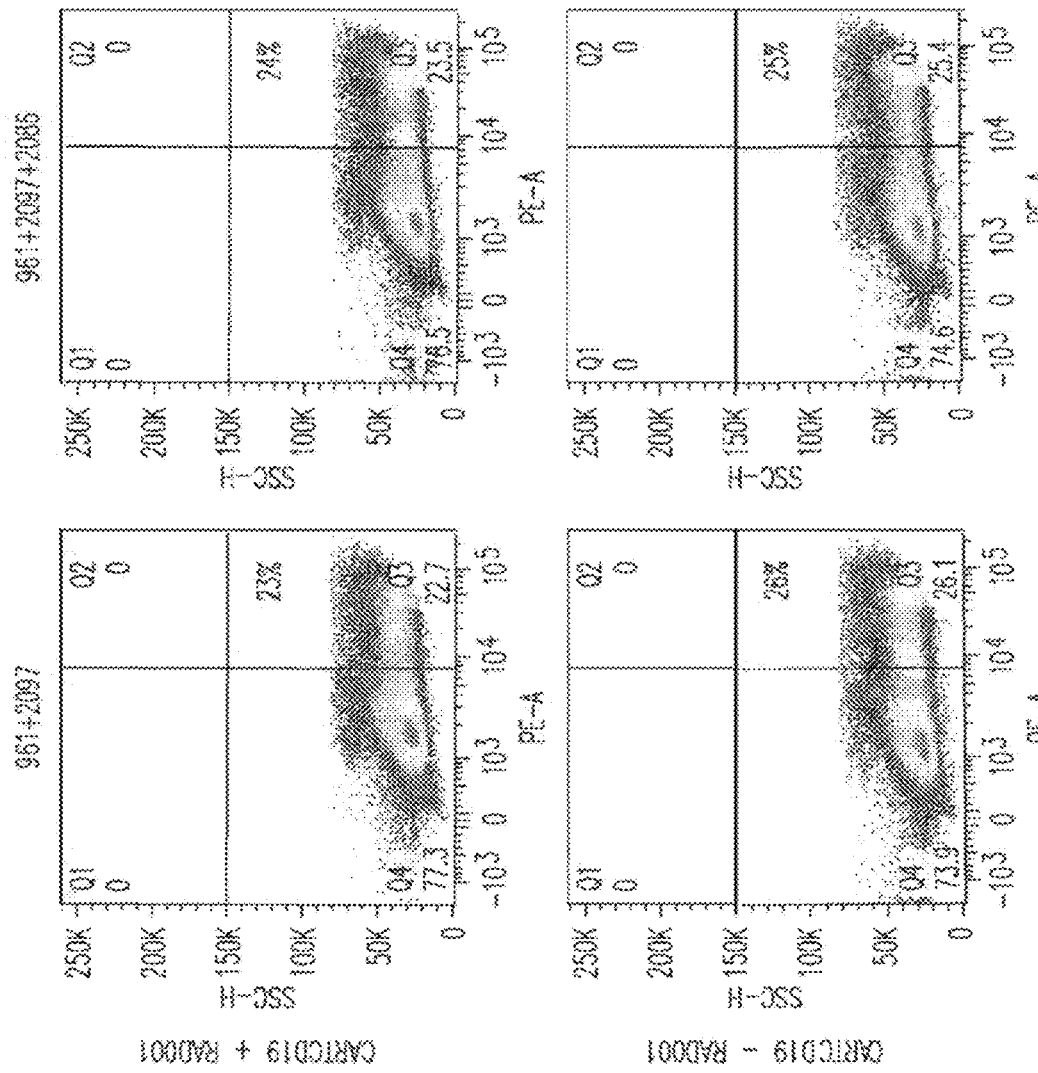
Figures 3, 58B:
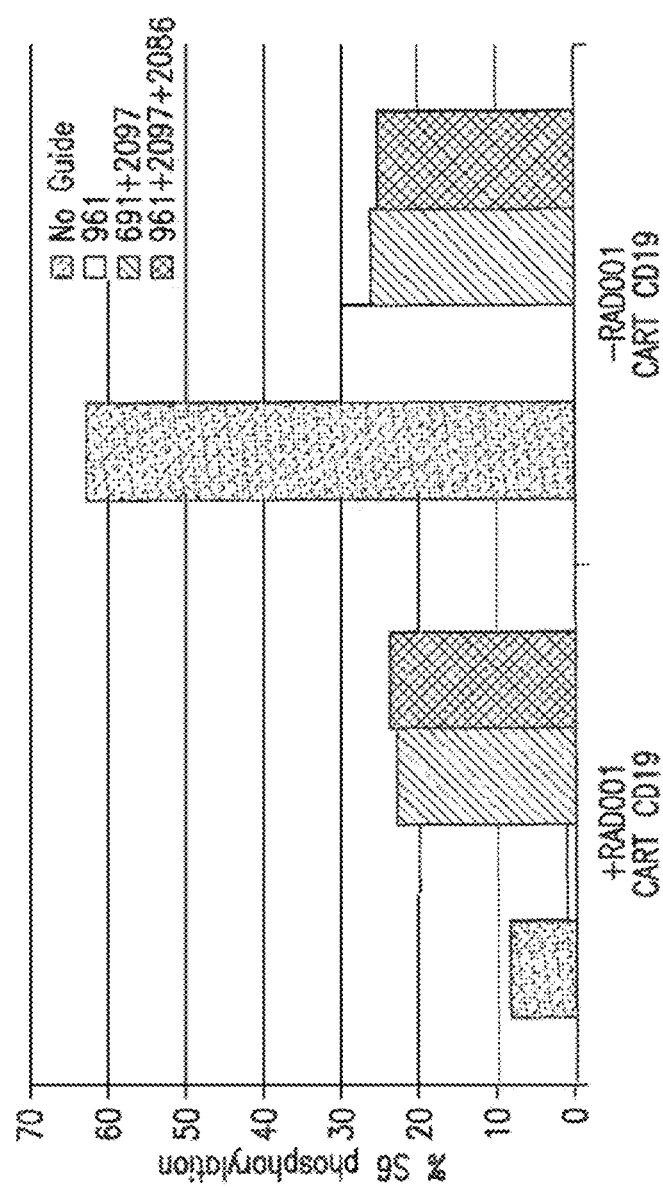
Figures 1, 58C:
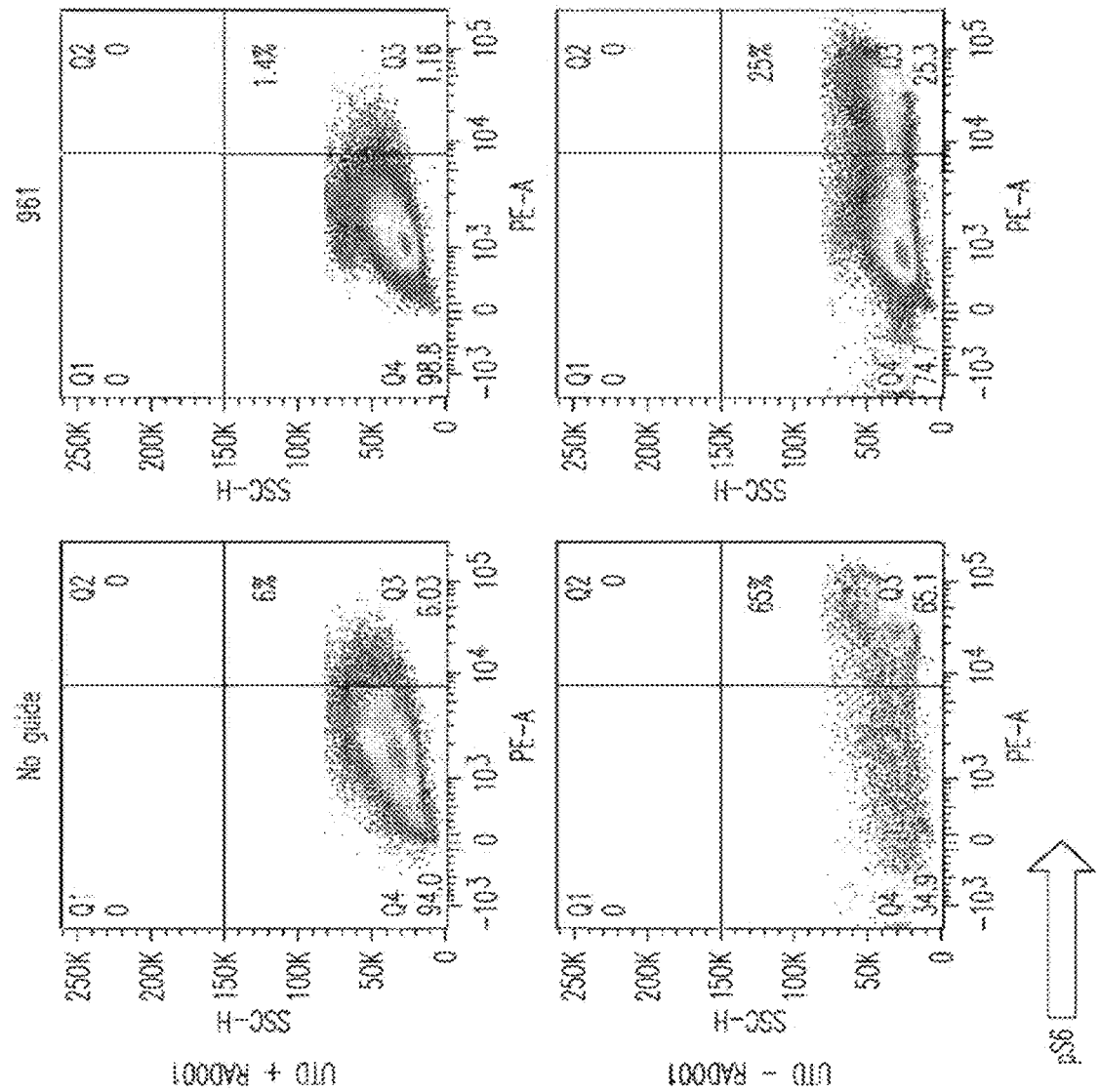
Figure 58C:
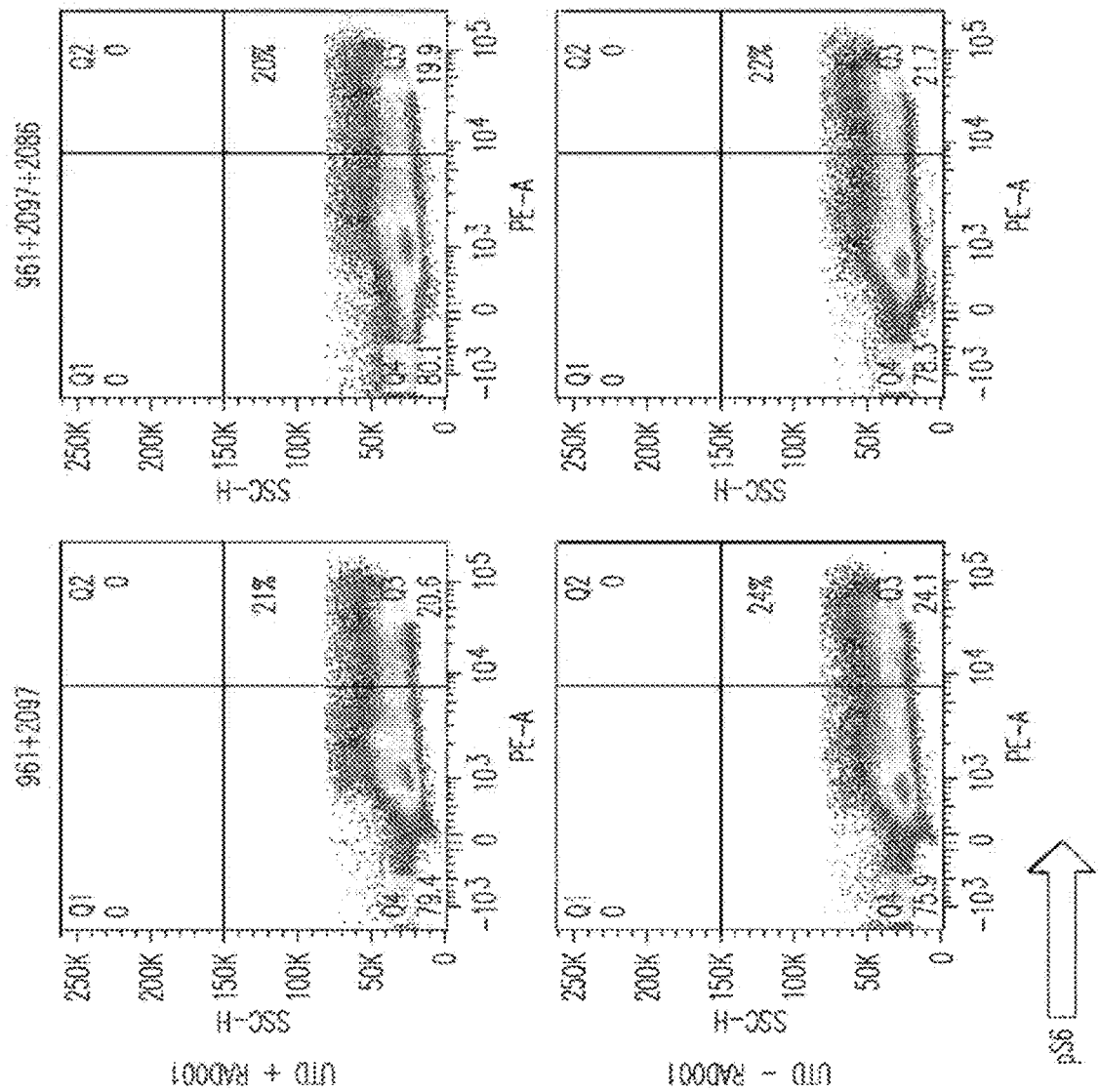
Figure 2:
Figures 3, 58C:
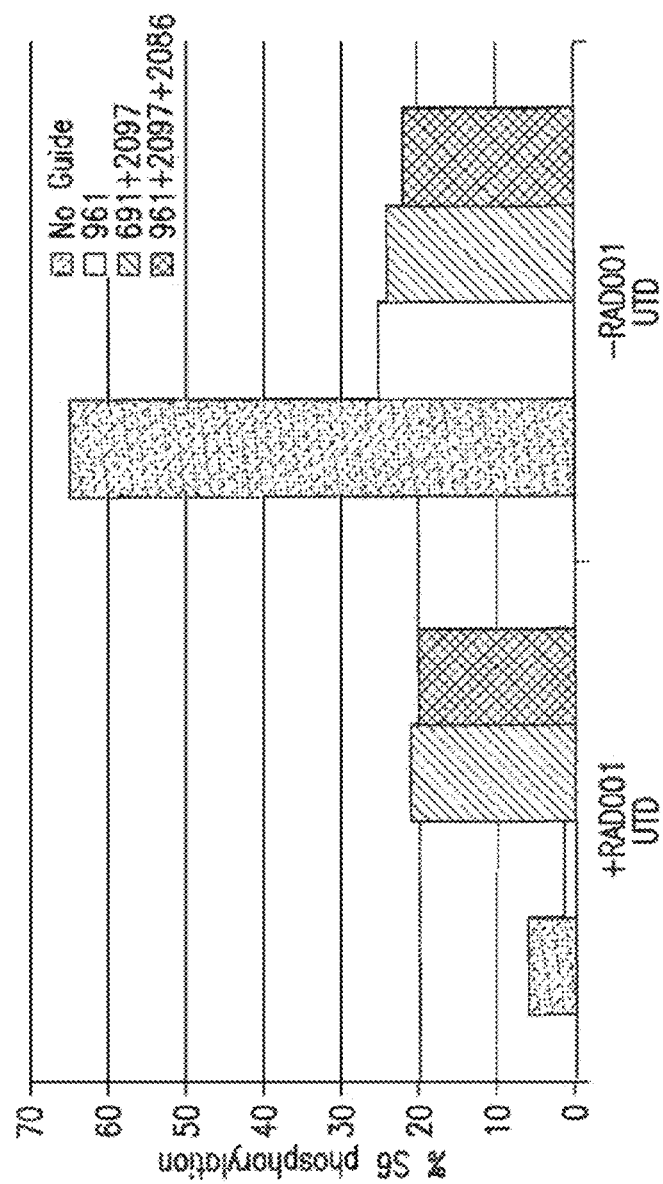

Results:

Cytokine production by CART cells in response to antigen exposure was determined. Gene editing was performed on CART cells using the CR000961 guide to target the TRAC locus and/or the CR002097 and CR002086 guides to target the FKBP1A locus (as indicated by cr961, 2097, and 2086, respectively). FIGS. 55A and 55B show interferon gamma release and IL-2 release, respectively, from edited/unedited CART cells. These data indicate that loss of FKBP12 and/or TCR through gene editing does not impair cytokine production in activated CART cells. FIG. 56 shows the killing of antigen positive cancer cell lines by edited and unedited CART cells. These data indicate that loss of FKBP12 and/or TCR through gene editing does not impair the target cell killing capacity of CART cells. FIG. 57 shows proliferation of edited and unedited CART cells in response to antigen exposure. These data indicate that loss of FKBP12 through gene editing does not impair the proliferation capacity of CART cells relative to cells treated with no guide. Finally, edited CART cells were investigated for their ability to resist immunosuppression by the rapalog RAD001. The results are shown in FIG. 58. These data indicate that editing of FKBP1A (and subsequence loss of FKBP12 protein) renders CART cells refractory to the inhibitory effects of the rapalog RAD001.

Example 14: Expression of HLA-G:B2M Fusion Protein

Without being bound by theory, it is believed that a cell that has been rendered TCR-B2M-/CIITA- may be recognized as foreign by NK cells and targeted for destruction. Thus, an otherwise unmodified TCR-/B2M-/CIITA- allogeneic CART cell may be at risk for attack when administered to, for example, a cancer patient. Again, without being bound by theory, it is believed that expression of HLA-G on said cells should suppress any NK cell activity against that cell. Because some forms of HLA-G require B2M, for cells in which expression of B2M has been reduced or eliminated, we investigated expression of a HLA-G:B2M fusion molecule.

The HLA-G/B2M fusion protein was synthesized as follows. β2 microglobulin and HLA-G amino acid sequences were obtained from databases. It is known that the HLA-G1 isoform of HLA-G forms a complex with B2M at the cell surface. In order to reconstitute this complex, for example, in a B2M- cell, the β2 microglobulin N terminal fusion polypeptide was linked to HLA-G1. Furthermore, B2M is linked to HLA-G1 through a glycine/serine (G4S)n linker (SEQ ID NO: 6629). The amino acid sequence was designed in the following order to create the fusion protein: B2M sequence—(G4S)3—HLA—G1 ("(G4S)3" disclosed as SEQ ID NO: 6594). The fusion protein nucleotide sequence was codon optimized by GeneArt® GeneOptimizer® process (Thermo Fisher Scientific Inc) for mammalian cell expression. Optimized DNA was synthesized by Genescript. Synthesized DNA was amplified by PCR (NEB, Q5® Hot Start High-Fidelity DNA Polymerase, Catalog number: M0493L) and subcloned to pELPS vector by Gibson Assembly (NEB, Catalog number: E2611L). Subclone sequence was further verified by genewiz sequencing.

HLA-G-B2M Virus or HLA-G virus was generated using LentiX-293T cells. The cells were transfected with HLA-G-B2M or HLA-G lentiviral DNA plasmid along with packaging plasmid DNA (pRSV.REV (Rev expression plasmid), pMDLg/p.RRE (Gag/Pol expression plasmid), pVSV-G (VSV glycoprotein expression plasmid)) using Lipofectamine 2000 (Invitrogen). Media was changed after 12 hours post transfection. Fresh media was added to the cells and supernatants were harvested 30 hours post media change. Using LentiX concentrator, the virus was concentrated and aliquoted to be frozen. Virus was tittered using supT1 cells. Serial dilution of supernatant containing virus was incubated with 20,000 SupT1 cells for 3 days. Fresh media was added 24 hr after transduction. Cells were harvested and washed with FACS buffer and incubated with anti HLA-G-PE antibody. (335906 Biolegend) and cells were analyzed using BD Fortessa and flowJo Software.

Figure 59:
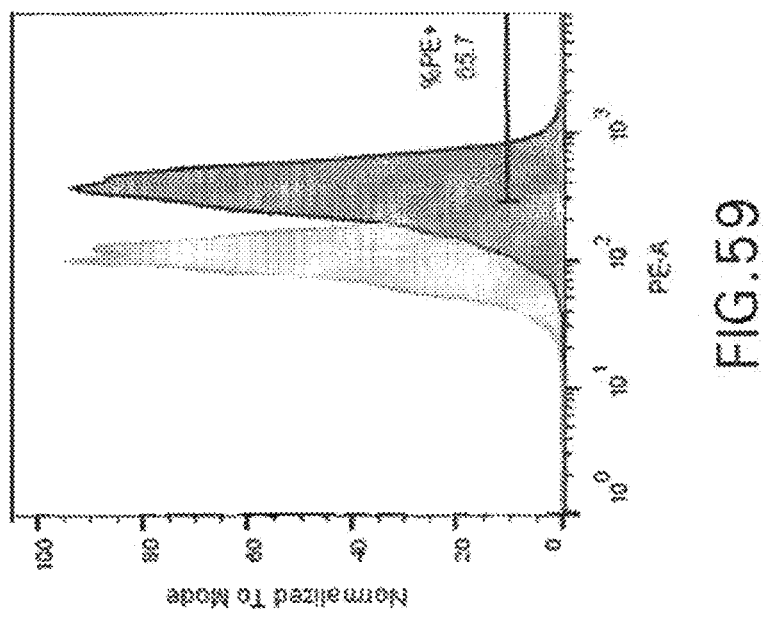
FIG. 59: Expression of HLA-G/B2M fusion protein in SupT1 cells, as detected by HLA-G flow cytometry. The light gray histogram indicates the background fluorescence in the PE channel in untransduced cells. The dark gray histogram indicates fluorescence in the PE channel from cells transduced with HLA-G/B2M.

FIG. 59 shows the results of transduction of SupT1 cells with nucleic acid encoding the HLA-G:B2M fusion described above. The HLA-G/B2M fusion protein was introduced into SupT1 cells by lentiviral transduction. Cells surface expression of HLA-G was detected by flow cytometry. The light gray histogram indicates the background fluorescence in the PE channel in untransduced cells. The dark gray histogram indicates fluorescence in the PE channel from cells transduced with HLA-G/B2M. This indicates successful expression and surface location of HLA-G:B2M fusion protein in T cells.

Example 15: Editing of CD3-Epsilon (CD3E) in HEK-293 (Cas9) Cells dgRNA molecules comprising the indicated targeting domain were chemically synthesized, and editing assessed in HEK-293 cells by NGS as described in Example 1. The results of the editing experiments are shown in Table 28. This Example shows gRNA molecules targeting CD3E are capable of editing the target locus when delivered as RNP at frequencies ranging from 3% to over 75%. Several gRNA molecules were able to edit more than 50% of the cells, including producing a frameshift mutation in more than 50% of the cells.

TABLE 28

% Edit and % Frameshift Edit with dgRNA to CD3E in HEK-293(Cas9) Cells

| Targeting Domain ID | Avg. % Edit (any indel) | Std. Dev. % Edit | Avg. Frameshift % | Std. Dev. Frameshift |
| --- | --- | --- | --- | --- |
| CR002275 | 76.01 | 5.72 | 15.70 | 0.95 |
| CR002282 | 67.86 | 4.87 | 49.37 | 3.04 |
| CR002272 | 64.58 | 4.15 | 46.13 | 2.53 |
| CR002317 | 64.37 | 8.01 | 52.67 | 7.38 |
| CR002242 | 62.63 | 14.18 | 60.27 | 13.41 |
| CR002254 | 60.61 | 11.17 | 57.40 | 10.85 |
| CR002253 | 60.56 | 12.93 | 57.47 | 12.22 |
| CR002238 | 59.48 | 9.56 | 47.73 | 8.60 |
| CR002316 | 58.02 | 6.94 | 33.73 | 1.04 |
| CR002244 | 57.67 | 8.32 | 55.70 | 7.45 |
| CR002273 | 56.67 | 14.54 | 41.70 | 12.21 |
| CR002269 | 55.71 | 9.82 | 39.57 | 6.98 |
| CR002234 | 53.46 | 5.59 | 48.40 | 4.19 |
| CR002306 | 52.44 | 2.86 | 39.37 | 2.12 |
| CR002294 | 50.53 | 2.60 | 43.10 | 2.51 |
| CR002239 | 49.40 | 10.43 | 41.43 | 9.15 |
| CR002263 | 49.02 | 10.60 | 46.10 | 9.98 |

TABLE 28-continued

% Edit and % Frameshift Edit with dgRNA to CD3E in HEK-293(Cas9) Cells

| Targeting Domain ID | Avg. % Edit (any indel) | Std. Dev. % Edit | Avg. Frameshift % | Std. Dev. Frameshift |
|---|---|---|---|---|
| CR002257 | 48.84 | 4.53 | 27.40 | 1.85 |
| CR002312 | 48.83 | 5.89 | 41.00 | 6.08 |
| CR002292 | 48.53 | 2.67 | 26.27 | 0.91 |
| CR002262 | 46.30 | 9.31 | 40.53 | 7.39 |
| CR002248 | 44.72 | 11.44 | 29.47 | 7.17 |
| CR002243 | 43.63 | 5.20 | 42.90 | 5.22 |
| CR002276 | 43.24 | 8.71 | 24.47 | 5.10 |
| CR002286 | 42.49 | 12.84 | 34.50 | 8.76 |
| CR002313 | 42.09 | 16.14 | 32.37 | 11.91 |
| CR002280 | 41.57 | 6.24 | 35.23 | 4.77 |
| CR002305 | 41.32 | 4.80 | 29.00 | 2.55 |
| CR002293 | 40.95 | 13.91 | 33.93 | 10.96 |
| CR002250 | 40.13 | 8.00 | 29.93 | 5.62 |
| CR002274 | 39.19 | 4.25 | 21.20 | 4.16 |
| CR002270 | 39.10 | 9.71 | 20.90 | 4.78 |
| CR002287 | 38.67 | 4.82 | 31.63 | 3.42 |
| CR002237 | 38.48 | 8.58 | 33.90 | 7.32 |
| CR002233 | 37.97 | 16.11 | 30.65 | 13.22 |
| CR002240 | 37.60 | 8.12 | 27.67 | 5.78 |
| CR002268 | 37.55 | 6.09 | 33.63 | 5.30 |
| CR002309 | 36.78 | 11.88 | 25.40 | 6.76 |
| CR002235 | 35.81 | 13.86 | 31.33 | 11.72 |
| CR002304 | 35.42 | 4.37 | 31.63 | 3.45 |
| CR002258 | 34.45 | 3.18 | 28.67 | 2.30 |
| CR002266 | 34.31 | 8.23 | 28.87 | 7.65 |
| CR002308 | 33.64 | 6.64 | 25.73 | 6.48 |
| CR002281 | 33.35 | 4.23 | 26.00 | 4.04 |
| CR002310 | 31.16 | 12.69 | 20.73 | 8.20 |
| CR002256 | 31.04 | 5.30 | 27.83 | 4.20 |
| CR002271 | 30.93 | 10.56 | 21.93 | 7.31 |
| CR002288 | 30.39 | 6.64 | 20.43 | 4.56 |
| CR002236 | 29.27 | 12.38 | 25.90 | 10.78 |
| CR002289 | 29.10 | 7.53 | 20.63 | 4.28 |
| CR002307 | 29.04 | 5.90 | 22.00 | 4.74 |
| CR002284 | 29.02 | 7.03 | 24.33 | 6.11 |
| CR002279 | 28.69 | 2.73 | 27.30 | 2.63 |
| CR002291 | 28.24 | 5.73 | 24.50 | 4.72 |
| CR002241 | 27.78 | 8.43 | 24.37 | 7.27 |
| CR002277 | 27.37 | 6.06 | 20.43 | 3.67 |
| CR002260 | 26.89 | 7.90 | 21.93 | 5.79 |
| CR002245 | 26.47 | 5.52 | 22.97 | 4.95 |
| CR002303 | 26.17 | 6.27 | 22.43 | 5.61 |
| CR002267 | 26.14 | 6.26 | 23.83 | 5.66 |
| CR002249 | 25.67 | 12.15 | 15.37 | 7.09 |
| CR002299 | 25.37 | 3.62 | 15.03 | 3.63 |
| CR002283 | 24.47 | 6.84 | 19.07 | 5.75 |
| CR002297 | 24.19 | 3.09 | 13.80 | 1.90 |
| CR002252 | 22.37 | 4.23 | 12.57 | 1.43 |
| CR002290 | 21.69 | 7.77 | 16.60 | 5.82 |
| CR002285 | 21.07 | 10.10 | 15.70 | 7.20 |
| CR002298 | 20.74 | 6.51 | 19.13 | 6.60 |
| CR002230 | 20.64 | 10.21 | 20.10 | 10.02 |
| CR002232 | 20.62 | 5.79 | 20.30 | 5.63 |
| CR002311 | 20.48 | 3.46 | 12.73 | 1.10 |
| CR002300 | 19.46 | 11.73 | 15.07 | 9.41 |
| CR002259 | 19.23 | 6.38 | 15.27 | 5.03 |
| CR002296 | 18.26 | 2.92 | 17.33 | 2.61 |
| CR002261 | 17.11 | 3.65 | 15.50 | 3.08 |
| CR002251 | 16.52 | 2.59 | 13.03 | 2.44 |
| CR002302 | 14.54 | 3.42 | 12.93 | 3.02 |
| CR002231 | 13.83 | 4.08 | 12.37 | 3.70 |
| CR002295 | 13.11 | 9.91 | 5.20 | 3.90 |
| CR002246 | 12.89 | 5.72 | 12.07 | 5.35 |
| CR002265 | 12.38 | 4.56 | 10.20 | 3.46 |
| CR002278 | 11.66 | 4.48 | 7.47 | 3.23 |
| CR002301 | 10.91 | 1.00 | 4.70 | 0.26 |
| CR002255 | 7.38 | 2.00 | 6.43 | 1.85 |
| CR002315 | 5.97 | 0.49 | 5.63 | 0.47 |
| CR002264 | 5.96 | 1.05 | 5.57 | 0.83 |
| CR002247 | 3.92 | 1.09 | 3.43 | 0.96 |
| CR002314 | 3.43 | 0.99 | 3.40 | 0.95 |

Example 16: Evaluation of Cas9 Variants

Evaluation in CD34+ Hematopoietic Stem Cells

Figure 60:
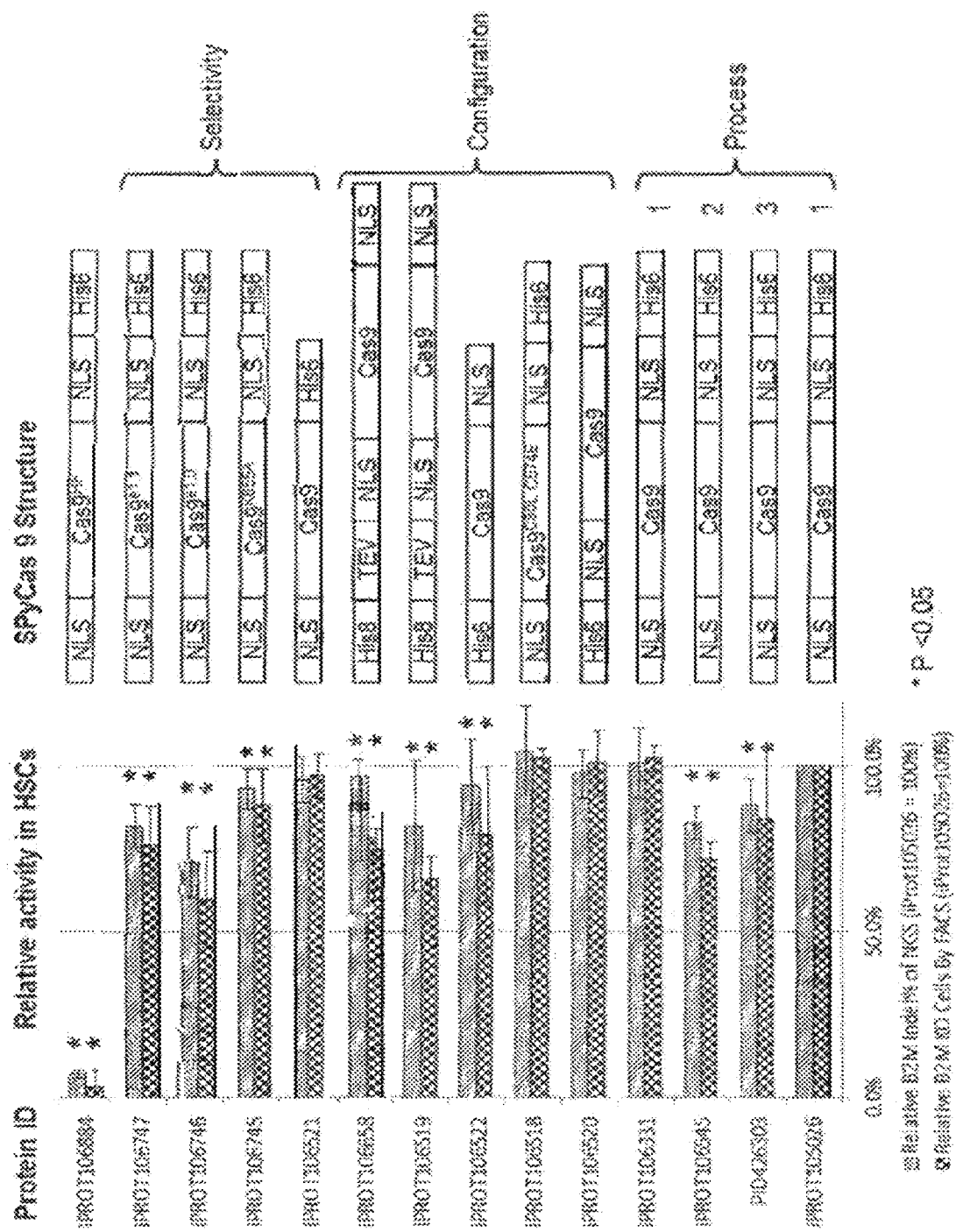
FIG. 60: Editing efficiency at targeted B2M locus in CD34+ hematopoietic stem cells by different Cas9 variants, as evaluated by NGS and Flow cytometry. NLS=SV40 NLS; His6 (SEQ ID NO: 10795) or His8 (SEQ ID NO: 10796) refers to 6 or 8 histidine residues, respectively; TEV=tobacco etch virus cleavage site; Cas9=wild type *S. pyogenes* Cas9-mutations or variants are as indicated).

We evaluated 14 purified *Streptococcus pyogenes* Cas9 (SPyCas9) proteins by measuring their efficiency of knocking out the beta-2-microglobulin (B2M) gene in primary human hematopoietic stem cells (HSCs). These proteins were divided into 3 groups: the first group consisted of SPyCas9 variants with improved selectivity (Slaymaker et al. 2015, Science 351: 84 (e1.0, e1.1 and K855A); Kleinstiver et al. 2016, Nature 529: 490 (HF)). The second group consisted of wild type SPyCas9 with different numbers and/or positions of the SV40 nuclear localization signal (NLS) and the 6× Histidine (His6) (SEQ ID NO: 10795) or 8× Histidine (His8) (SEQ ID NO: 10796) tag with or without a cleavable TEV site, and a SPyCas9 protein with two cysteine substitutions (C80L, C574E), which have been reported to stabilize Cas9 for structural studies (Nishimasu et al. 2014, Cell 156:935). The third group consisted of the same recombinant SPyCas9 produced by different processes (FIG. 60). B2M knockout was determined by FACS and next generation sequencing (NGS).

Methods

Materials

1. Neon electroporation instrument (Invitrogen, MPK5000)
2. Neon electroporation kit (Invitrogen, MPK1025)
3. crRNA (targeting domain of CR00441 (SEQ ID NO: 5495) fused to SEQ ID NO: 6607)
4. tracrRNA (SEQ ID NO: 6660)
5. Cas9 storage buffer: 20 mM Tris-C1, pH 8.0, 200 mM KCl, 10 mM $MgCl_2$
6. Bone marrow derived CD34+HSCs (Lonza, 2M-101C)
7. Cell culture media (Stemcell Technologies, StemSpam SFEM II with StemSpam CC-100)
8. FACS wash buffer: 2% FCS in PBS
9. FACS block buffer: per mL PBS, add 0.5 ug mouse IgG, 150 ug Fc block, 20 uL FCS
10. Chelex suspension: 10% Chelex 100 (bioRad, Cat #142-1253) in $H_2O$
11. Anti-B2M antibody: Biolegend, cat #316304

Process

Thaw and grow the cells following Lonza's recommendations, add media every 2-3 days. On day 5, pellet the cells at 200×g for 15 min, wash once with PBS, resuspend the cells with T-buffer from NEON kit at $2\times10^4$/uL, put on ice. Dilute Cas 9 protein with Cas9 storage buffer to 5 mg/ml. Reconstitute crRNA and tracrRNA to 100 uM with $H_2O$. The ribonucleoprotein (RNP) complex is made by mixing 0.8 uL each of CAS 9 protein, crRNA and tracrRNA with 0.6 uL of Cas9 storage buffer, incubate at room temperature for 10 min. Mix 7 uL of HSCs with RNP complex for two minutes and transfer the entire 10 uL into a Neon pipette tip, electroporate at 1700v, 20 ms and 1 pulse. After electroporation, immediately transfer cells into a well of 24-well plate containing 1 ml media pre-calibrated at 37° C., 5% $CO_2$. Harvest cells 72 hrs post-electroporation for FACS and NGS analysis.

FACS: take 250 uL of the cells from each well of 24-well plate, to wells of 96-well U-bottom plate and pellet the cells. Wash once with 2% FCS (fetal calf serum)-PBS. Add 50 uL FACS block buffer to the cells and incubate on ice for 10 minutes, add 1 uL FITC labeled B2M antibody and incubate for 30 minutes. Wash with 150 uL FACS wash buffer once followed by once more with 200 uL FACS wash buffer once. Cells were resuspended in 200 uL FACS buffer FACS analysis.

NGS sample prep: transfer 250 uL of cell suspension from each well of the 24-well plate to a 1.5 ml Eppendorf tube, add 1 mL PBS and pellet the cells. Add 100 uL of Chelex suspension, incubate at 99° C. for 8 minutes and vortex 10 seconds followed by incubating at 99° C. for 8 minutes, vortex 10 seconds. Pellet down the resin by centrifuging at 10,000×g for 3 minutes and the supernatant lysate is used for PCR. Take 4 uL lysate and do PCR reaction with the b2m primers (b2mg67F: CAGACAGCAAACTCACCCAGT (SEQ ID NO: 10807), b2mg67R: CTGACGCTTATCGACGCCCT (SEQ ID NO: 10808)) using Titanium kit (Clonetech, cat #639208) and follow the manufacturer's instruction. The following PCR conditions are used: 5 minutes at 98° C. for 1 cycle; 15 seconds at 95° C., 15 seconds at 62° C., and 1 minute at 72° C. for 30 cycles; and finally 3 minutes at 72° C. for 1 cycle. The PCR product was used for NGS.

Statistics: The percentage of B2M KO cells by FACS and the percentage of indels by NGS are used to evaluate the CAS 9 cleavage efficiency. The experiment was designed with Cas9 as fixed effect. Each experiment is nested within donors, as nested random effects. Therefore, the mixed linear model was applied for the analysis of FACS and NGS data.

Results

In order to normalize the experimental and donor variations, we graphed the relative activity of each protein to iProt105026, the original design with two SV40 NLS flanking the wild type SPyCas9 and the His6 tag (SEQ ID NO: 10795) at the C-terminal of the protein (FIG. 60). The statistical analysis shows that compared with the reference Cas9 protein iProt105026, iProt106331, iProt106518, iProt106520 and iProt106521 are not significantly different in knocking out B2M in HSCs, while the other variants tested (PID426303, iProt106519, iProt106522, iProt106545, iProt106658, iProt106745, iProt106746, iProt106747, iProt106884) are highly significantly different from the reference iProt105026 in knocking out B2M in HSCs. We found that moving the His6 tag (SEQ ID NO: 10795) from the C-terminal to N-terminal (iProt106520) did not affect the activity of the protein (FIG. 60). One NLS was sufficient to maintain activity only when it was placed at the C-terminal of the protein (iProt106521 vs. iProt106522, FIG. 60). Proteins purified from process 1 had consistent higher knockout efficiency than those from processes 2 and 3 (iProt106331 vs. iProt106545 & PID426303, FIG. 60). In general, the SPyCas9 variants with a reported improved selectivity were not as active as the wild type SPyCas9 (iProt106745, iProt106746 and iProt106747, FIG. 60). Interestingly iProt106884 did not cut the targeting site. This is consistent with the report by Kleinstiver et al that this variant failed to cut up to 20% of the legitimate targeting sites in mammalian cells (Kleinstiver et al. 2016, Nature 529: 490). Finally, the Cas9 variant with two cysteine substitutions (iProt106518) maintained high levels of enzymatic activity (FIG. 60).

Evaluation in T Cells

Methods

The different S Pyogenes Cas9 variants shown in Table 29 were used in these experiments. The structures are also shown in FIG. 60.

TABLE 29

Cas9 variants (NLS = SV40 NLS; Cas9 = S. Pyogenes Cas9 wild type, with any mutations indicated in parenthesis; Cas9e1.1 (as described in

| iprot | CAS9 (His6 disclosed as SEQ ID NO: 10795) | Size (Daltons) | Conc (ug/ml) | Molar conc. [uM] |
|---|---|---|---|---|
| 106520 | His6-GGS-NLS-CAS9-NLS | 161696.22 | 6.2 | 38.34 |
| 106518 | NLS-CAS9(C80L, C574E)-NLS-His6 | 161531.04 | 6.5 | 40.24 |
| 106521 | NLS-CAS9-His6 | 160629.9 | 6 | 37.12 |
| 106745 | NLS-CAS9(K855A)-NLS-His6 | 161437.94 | 5.9 | 36.55 |
| 106747 | NLS-CAS9e1.1-NLS-His6 | 161295.74 | 6.5 | 40.3 |
| 106154 (also referred to as 105026) | NLS-CAS9-NLS-His6 | 161495.04 | 5.9 | 36.54 |

PBMC were isolated from human blood (obtained from Hemacare/ALL Cells) by using centrifugation method using Ficoll (GE Healthcare catalog #17-1440-03). Total T cells were isolated from these PBMC's using human Pan T Cell Isolation Kit (Miltenyi Biotec #130-096-535). These cells were aliquoted, frozen using CRYOSTOR CS10 media (Biolife Solution-210102), and stored in liquid nitrogen. These frozen cell aliquots were then thawed in a 37 degree C. water bath for 20 secs and then transferred to a 50 ml conical tube in 10 ml of pre-warmed T cell media and centrifuged at 300 rpm for 5-10 mins at 24 degrees C. to remove the freezing media and resuspended with prewarmed T cell media. These are then activated by using CD3/CD28 beads (DynaBeads Invitrogen Cat #111.41D) at a bead to cell ratio of 3:1 at keeping the cell concentration at 0.5 million/ml and activated using CD3/CD28 beads (DynaBeads Invitrogen Cat #111.41D) at bead to cell ratio of 3:1 at 0.5 million/ml concentration of cells.

On Day 3 post bead activation, the 200,000 cells are used per electroporation. RNP complex used for T cell genome editing was formed using a 1:2 molar ratio of Cas9 protein to RNA (crRNA and tracRNA). 100 μM crRNA ([targeting domain]-[SEQ ID NO: 6607]) and 100 μM tracrRNA (SEQ ID NO: 6660) were denatured separately at 95° C. for 2 min and cooled to room temperature. In a final volume of 5 μL, 1.4 μL of Cas9 proteins at a concentration of 5.9 μg/μL was mixed with 1.6 μL of reaction buffer (20 mM Tris, pH8.0; 200 mM KCL, 10 mM MgCl2) and mixed with 1 μL of 100 μM tracrRNA at room temperature. Next 1 μL of 100 μM crRNA was added, mixed and incubated for 10 min at 37° C. The targeting domain for B2M was CR000442, and for TRAC was CR000961. These RNP's at higher concentrations were used to generate samples of RNP serial dilutions. These RNP dilutions were then used to mix with 200,000 cells in 10 ul of T Buffer (neon transfection system 10 ul Kit). Electroporation was performed by Neon electroporator using Neon® Transfection System 10 μL Kit (MPK1096) at 1600V, 10 ms, 3 pulses. Cells were cultured in T cell media without antibiotics. Cells were taken from each sample pipetted to dissociate them from beads and beads were removed by using 96 welled plate magnet and centrifuged with 100 ul of FACS buffer (Miltenyi MACS buffer catalog

130-092-987 with 0.5% BSA (Miltenyi-catalog #130-091-376) to wash the cells. Cells were then incubated with different antibodies diluted in 100 ul FACS buffer for 30 mins on ice. Cells were then washed two times with 200 ul of FACS buffer. Cells are then resuspended in 150 ul of FACS buffer and run on BD 5 laser Fortessa. Expression of TCR was detected by using anti-CD3-PercpCy5.5 (Ebiosciences 45-0037-42) and expression of B2M was detected by using anti-B2M-APC (316312 Biolegend). Flow cytometry data was analyzed using FlowJo Software.

Results

Figure 61:
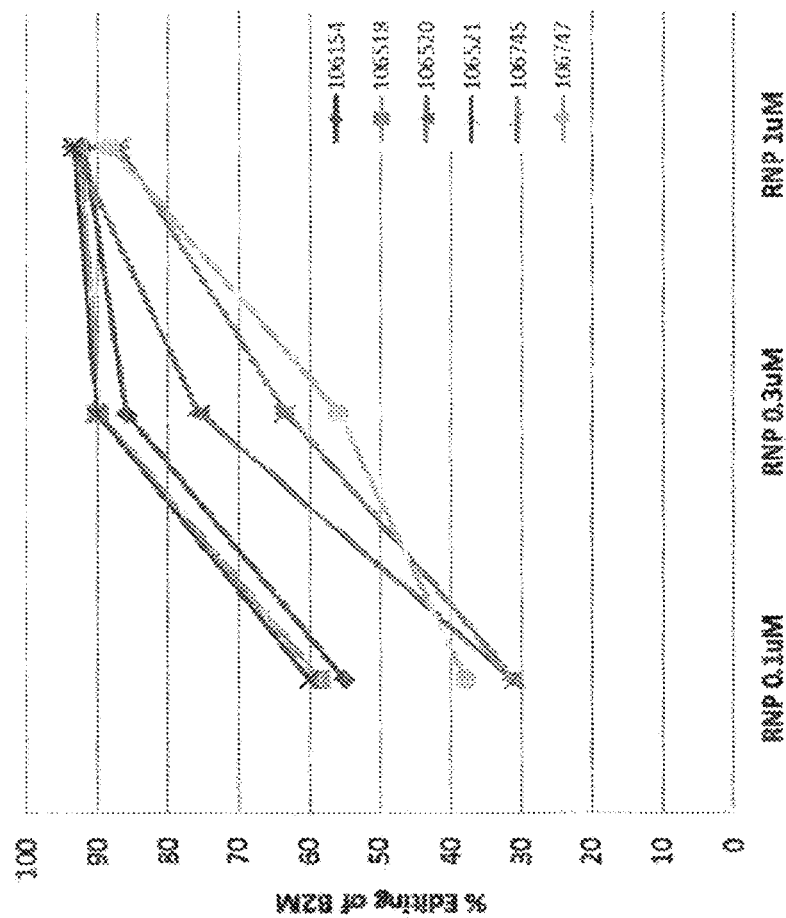
FIG. 61: Editing efficiency at targeted B2M locus in primary human T cells by different Cas9 variants and a range of concentrations, as measured by flow cytometry.
Figure 62:
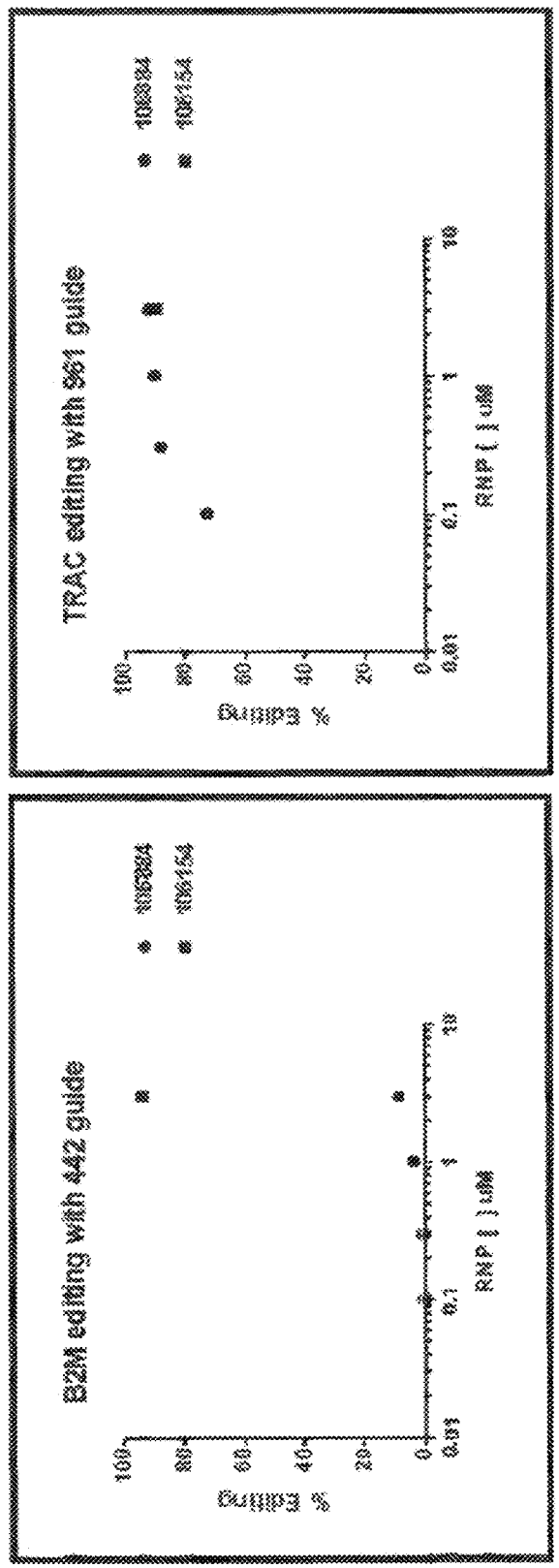
FIG. 62: Editing efficiency of two different Cas9 variants, at various concentrations, in primary human T cells using two different gRNAs targeting either B2M (left panel) or TRAC (right panel). Editing efficiency (% editing) was measured by flow cytometry by measuring the loss of cell surface expression of B2M (left panel) or TCR (right panel).

Generation of low concentrations of RNP, and highest editing efficiency, proceeded well when RNP was generated at high concentration, and then diluted to the desired concentrations. 6 different Cas9 proteins were tested for efficiency of editing using the B2M guide CR00442 in primary T cells. Editing efficiency was measured using cell surface detection by flow cytometry of the B2M protein and the results are shown in FIG. 61 (Y-axis; % Editing of B2M) 3 days after RNP electroporation at the indicated concentrations of RNP (X-axis). The different Cas9 proteins tested are indicated by their "iprot" ID numbers (see FIG. 60 and Table. The results are shown in FIG. 61. These data indicate that all of these variants of Cas9 are active, but Cas9 proteins 106521, 106518, and 106154 (also referred to as 105026) show higher activity in T cells, as evidenced by their greater activity at lower concentrations of RNP. Next, two different Cas9 proteins, 106884 or 106154 (also referred to as 105026), as indicated, were tested for editing efficiency using the B2M targeting guide CR00442 (FIG. 62, left panel) or the TRAC targeting guide CR000961 (FIG. 62, right panel) by using different concentrations of RNP as indicated on the X-axis. Editing efficiency (% editing) was measured by flow cytometry by measuring the loss of cell surface expression of B2M (FIG. 62, left panel) or TCR using CD3 epsilon antibody (FIG. 62, right panel).

Example 17: Off-Target Evaluation

T Cell Culture and CRISPR/Cas9 Genome Editing

Peripheral blood mononuclear cells (PBMC) were isolated from human blood (HemaCare, Cat #PB000) using standard Ficoll density gradient centrifugation methods. Total T cells were isolated from PBMC using the Pan T Cell Isolation Kit for human cells (Miltenyi Biotec, Cat #130-096-535) following manufacturer's recommendations and stored at −80° C. T cells were thawed and activated using Dynabeads Human T-Activator CD3/CD28 for T Cell Expansion and Activation (Thermo Fisher Scientific, Cat #11131D) at a 3:1 bead to cell number ratio following manufacturer's recommendations. T cells were cultured in antibiotic-free complete T cell medium (RPMI 1640 with L-glutamine, Lonza, Cat #12-702F; 10% FBS, GE HyClone, Cat #SH30071; 200 mM L-glutamine, GE HyClone, Cat #SH30034.01; 10 mM non-essential amino acids, GE HyClone, Cat #13-114E; 100 mM sodium pyruvate, Invitrogen, Cat #11360-070; 1 M HEPES buffer, GE HyClone, Cat #17-737E and 55 mM 2-mercaptoethanol, Invitrogen, Cat #21985-023) at 37° C., 5% $CO_2$ for 3 days prior to genome editing.

RNP complex used for T cell genome editing was formed using a 1:2 molar ratio of Cas9 protein to gRNA (crRNA and tracRNA). Chemically synthesized crRNA at a concentration of 100 µM ([targeting domain]-[SEQ ID NO: 6607]) and tracr (SEQ ID NO: 6660) at a concentration of 100 µM were denatured separately at 95° C. for 2 mM and cooled to room temperature. In a final volume of 5µ buffer (20 mM Tris, pH8.0; 200 mM KCL, 10 mM $MgCl_2$), Cas9 protein (NLS-Cas9-NLS-His6 ("His6" disclosed as SEQ ID NO: 10795); iPROT105026; NLS=SV40 NLS; Cas9=wt S. Py Cas9) was first mixed with tracrRNA at room temperature and then mixed with crRNA and incubated for 5 min at 37° C. Final concentrations of Cas9 protein, tracrRNA and crRNA used were 10 µM, 20 µM and 20 µM respectively. Bead activated T cells were collected by centrifugation and resuspended in the Neon electroporation kit T buffer (Invitrogen; Cat #MPK1096) at a cell density of $20 \times 10^6$/mL. 5 µL of RNP was mixed with 10 µl of T cells by gentle pipetting and incubated at room temperature for 5 min. The RNP T cell mixture was transferred into a 10 µL Neon electroporation tip probe. Electroporation was performed using the Neon transfection system (Invitrogen; MPK5000S) using the following conditions: 3 pulses of 1600 volts/10 milliseconds. Duplicate 10 µL electroporation reactions were performed. Electroporated T cells were then immediately transferred into 200 µL pre-warmed antibiotics-free complete T cell medium in a 96 well plate and incubated at 37° C., 5% $CO_2$ for 2 days. T cells were then diluted at 1:1 volume using antibiotics-free complete T cell medium and transferred to a 24 well plate and cultured an additional 4-7 days at 37° C., 5% $CO_2$. In parallel activated T cells without RNP treatment were similarly cultured to serve as untreated control samples. T cells were then collected by centrifugation and genomic DNA was isolated from 1-2 million cells using the DNeasy Blood & Tissue Kit (Qiagen, Cat #69506) following the manufacturer's recommendations. Genome editing was performed for gRNAs comprising the targeting domain sequences of CR00442, CR00444, CR000961 and CR000984 generating two treated and one untreated replicate per gRNA.

In Silico Identification of Potential gRNA Off-Target Loci

For gRNAs CR00442, CR00444, CR000961 and CR000984, potential off-target loci were identified by aligning the 20 nucleotide gRNA protospacer sequence to the human genome reference sequence (build GRCh38) using the BFAST sequence aligner (version 0.6.4f, Homer et al, PLoS One, 2009, 4(11), e7767, PMID: 19907642) using standard parameters allowing up to 5 nucleotide mismatches. Loci identified were filtered to only contain sites that are 5' adjacent to the Cas9 canonical 5'-NGG-3' PAM sequence (i.e. 5'-off-target locus-PAM-3'). Using the BEDTools script (version 2.11.2, Quinlan and Hall, Bioinformatics, 2010 26(6):841-2, PMID: 20110278) sites with 5 nucleotide mismatches were further filtered against RefSeq gene annotations (Pruitt et al, Nucleic Acids Res., 2014 42 (Database issue):D756-63, PMID: 24259432) to only contain loci annotated as exons. Counts of the potential off-target loci identified for each gRNA are shown in Table 30.

TABLE 30

Counts of in silico off-target loci identified for gRNAs CR00442, CR00444, CR000961 and CR00098 with 0, 1, 2, 3 and 4 nucleotide mismatches and 5 nucleotide mismatches within RefSeq exons are shown.

| Gene | gRNA name | Number of off-targets with N mismatches | | | | | 5 RefSeq exons | Total |
|---|---|---|---|---|---|---|---|---|
| | | 0 | 1 | 2 | 3 | 4 | | |
| B2M | CR00442 | 0 | 0 | 0 | 7 | 72 | 71 | 150 |
| | CR00444 | 0 | 0 | 0 | 2 | 24 | 33 | 59 |
| TRAC | CR000961 | 0 | 0 | 2 | 23 | 224 | 63 | 312 |
| | CR000984 | 0 | 0 | 0 | 3 | 40 | 15 | 58 |

PCR Primer Design for Targeted Amplification of Potential Off-Target Sites

PCR amplicons targeting potential off-target loci (and the on-target locus) identified for gRNAs CR00442, CR00444, CR000961 and CR00098 were design using Primer3 (version 2.3.6, Untergasser et al, Nucleic Acids Res., 2012 40(15):e115, PMID: 22730293) using default parameters aiming for an amplicon size range of approximately 160-300 bp in length with the gRNA protospacer sequence located in the center of the amplicon. Resulting PCR primer pairs and amplicon sequences were checked for uniqueness by BLAST searching (version 2.2.19, Altschul et al, J Mol Biol., 1990, 215(3):403-10, PMID: 2231712) sequences against the human genome reference sequence (build GRCh38). Primer pairs resulting in more than one amplicon sequence were discarded and redesigned. Table 31 provides a count of successful primer pairs designed for each gRNA.

Illumina Sequencing Library Preparation, Quantification and Sequencing

Genomic DNA from RNP treated (2 replicates per gRNA) and untreated (1 replicate per gRNA) T-cell samples was quantified using the Quant-iT PicoGreen dsDNA kit (Thermo Fisher, Cat #P7581) using manufacture's recommendations. Illumina sequencing libraries targeting individual off-target loci (and the on-target locus) were generated for each sample using two sequential PCR reactions. The first PCR amplified the target locus using target specific PCR primers (designed above) that were tailed with universal Illumina sequencing compatible sequences. The second PCR added additional Illumina sequencing compatible sequences to the first PCR amplicon, including sample barcodes to enable multiplexing during sequencing. PCR 1 was performed in a final volume of 10 µL with each reaction containing 6 ng of gDNA (equivalent to approximately 1000 cells), PCR 1 primer pairs (Integrated DNA Technologies) at a final concentration of 0.25 uM and 1× final concentration of Q5 Hot Start Master Mix (New England BioLabs, Cat #102500-140). PCR 1 left primers were 5' tailed (i.e. 5'-tail-target specific left primer-3') with sequence 5'-TCGTCGGCAGCGTCAGATGTGTATAAGAGACAG-3' (SEQ ID NO: 10810) and right primers were 5' tailed (i.e. 5'-tail-target specific right primer-3') with sequence 5'-GTCTCGTGGGCTCGGAGATGTGTATAAGA-GACAG-3' (SEQ ID NO: 10811). PCR 1 was performed on a thermocycler using the following cycling conditions: 1 cycle of 98° C. for 1 min; 25 cycles of 98° C. for 10 sec, 63° C. for 20 sec, and 72° C. for 30 sec; 1 cycle at 72° C. for 2 min. PCR 1 was then diluted 1 in 100 using nuclease free water (Ambion, Cat #AM9932) and used as input into PCR 2. PCR 2 was performed in a final volume of 10 pit with each reaction containing 2 µL of diluted PCR 1 product, PCR 2 primer pairs (Integrated DNA Technologies) at a final concentration of 0.5 µM and 1× final concentration of Q5 Hot Start Master Mix (New England BioLabs, Cat #102500-140). PCR 2 left primer sequence used was 5'-AATGA-TACGGCGACCACCGAGATCTA-CACTCGTCGGCAGCGTC-3' (SEQ ID NO: 10812) and PCR 2 right primer sequence used was 5'-CAAGCAGAA-GACGGCAT-ACGAGATNNNNNNNNGTCTCGTGGGCTCGG-3' (SEQ ID NO: 10813) where the NNNNNNNN denote an 8 nucleotide barcode sequence used for sample multiplexing as part of the standard Illumina sequencing process. PCR 2 was performed on a thermocycler using the following cycling conditions: 1 cycle of 72° C. for 3 min; 1 cycle of 98° C. for 2 min; 15 cycles of 98° C. for 10 sec, 63° C. for 30 sec, and 72° C. for 2 min. PCR 2 amplicons, now viable Illumina sequencing libraries, were cleaned up using Agencourt AMPure XP beads (Beckman Coulter, Cat #A63882) following the manufacture's recommendations. The cleaned Illumina sequencing libraries were then quantified using standard qPCR quantification methods using Power SYBR Green PCR master mix (Life Technologies, Cat #4367660) and primers specific to the Illumina sequencing library ends (forward primer sequence 5'-CAAGCAGAAGACGGCAT-ACGA-3' (SEQ ID NO: 10814) and reverse primer sequence 5'-AATGATACGGCGACCACCGAGA-3' (SEQ ID NO: 10815)). Illumina sequencing libraries were then pooled equimolar and subjected to Illumina sequencing on a MiSeq instrument (Illumina, Cat #SY-410-1003) with 300 base paired-end reads using a MiSeq Reagent Kit v3 (Illumina, Cat #MS-102-3003) following the manufacture's recommendations. A minimum of 1000-fold sequence coverage was generated for each locus. PCR, cleanup, pooling and sequencing of treated and untreated samples were performed separately to avoid any possibility of cross contamination between treated and untreated samples or PCR amplicons generated therefrom.

Illumina Sequencing Data QC and Variant Analysis

Using default parameters, the Illumina MiSeq analysis software (MiSeq reporter, version 2.6.2, Illumina) was used to generate amplicon specific FASTQ sequencing data files (Cock et al, Nucleic Acids Res. 2010, 38(6):1767-71, PMID: 20015970). FASTQ files were then processed through an internally developed variant analysis pipeline consisting of a series of public domain software packages joined together using a standard Pert script wrapper. The workflow used was divided into five stages.

Stage 1, PCR primer and on- and off-target sequence QC: For both on- and off-target sites the 20 nucleotide gRNA protospacer sequence plus PAM sequence and target specific PCR primer sequences (left and right without the additional Illumina sequenced) were aligned to the human genome reference sequence (build GRCh38) using a BLAST search (version 2.2.29+, Altschul et al, J Mol Biol., 1990, 215(3): 403-10, PMID: 2231712). On- and off-target sites with multiple genomic locations were flagged.

Stage 2, sequencer file decompression: Illumina sequencer generated FASTQ.GZ files were decompressed to FASTQ files using the gzip script (version 1.3.12) and number of reads per file was calculated. Files with no reads were excluded from further analysis.

Stage 3, sequence read alignment and quality trimming: Sequencing reads in FASTQ files were aligned to the human genome reference sequence (build GRCh38) using the BWA-MEM aligner (version Li and Durbin, Bioinformatics, 2009, 25(14):1754-60, PMID: 19451168) using 'hard-clipping' to trim 3' ends of reads of Illumina sequences and low quality bases. Resulting aligned reads, in the BAM file format (Li et al, Bioinformatics, 2009 25(16):2078-9, PMID: 19505943), were converted to FASTQ files using the SAMtools script (version 0.1.19-44428cd, Li et al, Bioinformatics, 2009 25(16):2078-9, PMID: 19505943). FASTQ files were then aligned again to the human genome reference sequence (build GRCh38) using the BWA-MEM aligner, this time without 'hard-clipping'.

Stage 4, variant (SNP and INDEL) analysis: BAM files of aligned reads were processed using the VarDict variant caller (version 1.0 'Cas9 aware' modified by developer ZhangWu Lia, Lai et al, Nucleic Acids Res., 2016, 44(11): e108, PMID: 27060149) with allele frequency detection limit set at >=0.0001 to identify variants (SNPs and INDELs). The Cas9 aware VarDict caller is based on a public domain package but able to move ambiguous variant calls, generated due to repetitive sequences in the alignment region of the variant events, toward the potential Cas9 nuclease cut site in the gRNA protospacer sequence located 3 bases 5' of the PAM sequence. The SAMtools script was used to calculate read coverage per sample amplicon to determine whether the on- and off-target sites were covered at >1000-fold sequence coverage. Sites with <1000-fold sequence coverage were flagged and more sequencing data was generated.

Stage 5, dbSNP filtering and treated/untreated differential analysis: Variants identified were filtered for known variants (SNPs and INDELs) found in dbSNP (build 142, Shery et al, Nucleic Acids Res. 2001, 29(1):308-11, PMID: 11125122). Variants in the treated samples were further filtered to exclude: 1) variants identified in the untreated control samples; 2) variants with a VarDict strand bias of 2:1 (where forward and reverse read counts supporting the reference sequence are balanced but imbalanced for the non-reference variant call); 3) variants located outside a 100 bp window around the potential Cas9 cut site; 4) single nucleotide variants within a 100 bp window around the potential Cas9 cut site. Finally only sites with a combined INDEL frequency of >2% (editing in more than approximately 20 cells) in a 100 bp window of the potential Cas9 cut site were considered. Potential active editing sites were further examined at the read alignment level using the Integrative Genome Viewer (IGV version 2.3, Robinson et al, Nat Biotechnol. 2011, 9(1):24-6, PMID: 21221095) that allows for visual inspection of read alignments to the genome reference sequence. Sites identified to have potential off-target activity were reworked a second time through the entire laboratory (starting with PCR) and analysis process.

On- and Off-Target Analysis Results

On-target sites for gRNA CR00442, CR00444, CR000961 and CR000984 all showed robust editing at the intended Cas9 cut site in both treated biological replicates with an average variant frequency of 96%, 84%, 81%, and 98% respectively. No editing was observed in any of the untreated control samples. Table 31 shows number of off-target sites identified and characterized. Uncharacterized sites either failed in PCR primer design or PCR amplification and are currently still under investigation.

gRNA CR00442: The on-target site for gRNA CR00442 showed robust editing at the intended Cas9 cut site in both treated biological replicates with an average INDEL frequency of 96%. No editing was observed in the untreated control sample. Table 31 shows the number of off-target sites characterized. Uncharacterized sites failed in PCR primer design or PCR amplification and are currently still under investigation. Characterization of potential off-target sites identified two weak off-target sites for gRNA CR00442 with average INDEL frequencies of 3.7% and 4.4% in the 100 bp window around the proposed Cas9 cut site. One site has 3 mismatches relative to the on-target gRNA protospacer sequence (5'-GGCaACaGAGCGAGACAaCT-PAM-3', PAM=GGG (SEQ ID NO: 10816)) and is located in intron 1 of the zinc finger protein 440 gene (ZNF440) on chromosome 19 at base pair position 11,815,253-11,815,275, approximately 0.9 kb away from exon 1. The second site also has 3 mismatches relative to the on-target gRNA protospacer sequence (5'-GGCgACaGAaCGAGACATCT-PAM-3', PAM=CGG (SEQ ID NO: 10817)) and is located in intron 9 of the epithelial cell-transforming sequence 2 oncogene-like gene (ECT2L) on chromosome 6 at base pair position 138,856,234-138,856,256, approximately 2 kb away from exon 9. Manual inspection of both sites showed typical INDEL patterns surrounding the proposed Cas9 cut sites typical of Cas9 mediated double stranded break non homologous end joining DNA repair. Reamplification and sequencing of both sites gave similar results. It is unclear whether editing at either site identified has any detrimental effect on gene expression or cell viability, further analysis is required.

gRNA CR00444: The on-target site for gRNA CR00444 showed robust editing at the intended Cas9 cut site in both treated biological replicates with an average INDEL frequency of 84%. No editing was observed in the untreated control sample. Table 31 shows the number of off-target sites successfully characterized. Uncharacterized sites failed in PCR primer design or PCR amplification and are currently still under investigation. To date no significant off-target activity was observed for gRNA CR00444 at sites examined. However, as Table 31 shows, there are still two sites that have not yet been characterized, one with 4 mismatches located in an intergenic region and another with 5 mismatches located in exon 4 of the non-coding dynamin 1 pseudogene 46 gene (DNM1P46). Based on the high number of mismatches in these sites it is expected that these sites will likely not show any significant editing, however further analysis is required to confirm this.

gRNA CR000961: The on-target site for gRNA CR000961 showed robust editing at the intended Cas9 cut site in both treated biological replicates with an average INDEL frequency of 81%. No editing was observed in the untreated control sample. Table 31 shows the number of off-target sites successfully characterized. Uncharacterized sites failed in PCR primer design or PCR amplification and are currently still under investigation. Characterization of potential off-target sites identified one weak off-target site for gRNA CR000961 with an average INDEL frequency of 5.5% in the 100 bp window around the proposed Cas9 cut site. The site has 3 mismatches relative to the gRNA protospacer sequence (5'-AaAGTCaCaCAGCTGGTACA-PAM-3', PAM=TGG (SEQ ID NO: 10818)) and is located in intron 12 of the doublecortin domain-containing protein 1 gene (DCDC1) on chromosome 11 at base pair position 31,102,920-31,102,942, approximately 0.6 kb away from exon 13. Manual inspection of the site showed typical INDEL patterns surrounding the proposed Cas9 cut sites typical of Cas9 mediated double stranded break non homologous end joining DNA repair. Reamplification and sequencing of the site gave similar results. It is unclear whether editing at this site has any detrimental effect on gene expression or cell viability, however further analysis is required.

gRNA CR000984: The on-target site for gRNA CR000984 showed robust editing at the intended Cas9 cut site in both treated biological replicates with an average INDEL frequency of 98%. No editing was observed in the untreated control sample. Table 31 the shows the number of off-target sites successfully characterized. Uncharacterized sites failed in PCR primer design or PCR amplification and are currently still under investigation. Characterization of off-target sites identified no significant off-target activity for gRNA CR000984 at sites examined. However, as Table 31 shows, there is still one site that has not yet been characterized. The site has 5 mismatches and is located in an exon of an uncharacterized long non-coding RNA (LOC440896). Based on the high number of mismatches it is expected that this site will likely not show any significant editing, however further analysis is required to confirm this.

TABLE 31

Counts of total number of potential off-target sites, number of successfully characterized off-target sites and number of active off-target sites identified for gRNAs CR00442, CR00444, CR000961 and CR000984 are shown.

| Gene | Targeting domain gRNA name | Total number of off-target sites | Number of off-target sites characterized | Number of active off-target sites identified |
|---|---|---|---|---|
| B2M | CR00442 | 150 | 147 (98%) | 2 |
|  | CR00444 | 59 | 57 (97%) | 0 |
| TRAC | CR000961 | 312 | 306 (98%) | 1 |
|  | CR000984 | 58 | 57 (98%) | 0 |

GUIDE-Seq Hit Validation Results

Potential off-target loci identified using the GUIDE-seq method (Tsai et al, Nat Biotechnol. 2015, 33(2):187-97, PMID: 25513782) were characterized in RNP treated and untreated T cells using the same methods described for in silico identified sites. GUIDE-Seq identified 2 potential sites for gRNA CR00442, 1 potential site for CR00444 and 1 potential site for gRNA CR000984. No active sites were identified for gRNA CR000961. Target sequencing analysis of all potential GUIDE-seq sites showed no significant activity in RNP treated T cells tested.

Off-Target Editing Assessment by Insertional Analysis

Figure 63:
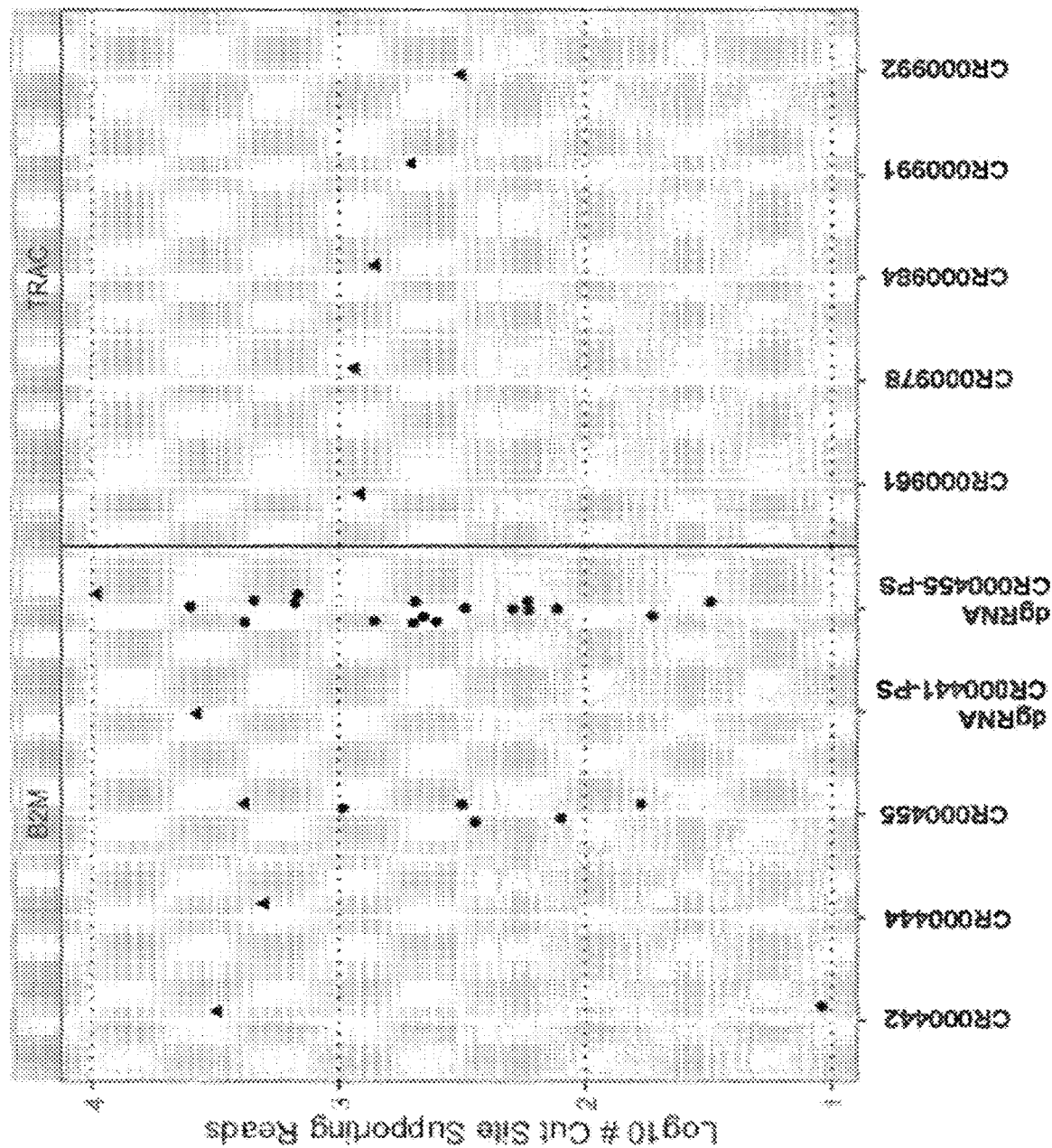
FIG. 63: Off-target activity for TRAC and B2M guides was assessed using an dsDNA oligo-insertion method in Cas9 overexpressing HEK-293 cells. The on-target site (triangle) and the potential off-target sites (circles) detected are indicated; y-axis indicates frequency of detection. All gRNAs were tested in dgRNA format with the targeting domain indicated by the CRxxxxx identifier. Where indicated, each gRNA was modified such that the 5' three internucleotide bonds and the 3' three internucleotide bonds are phosphorothioate bonds ("PS").
Figure 64:
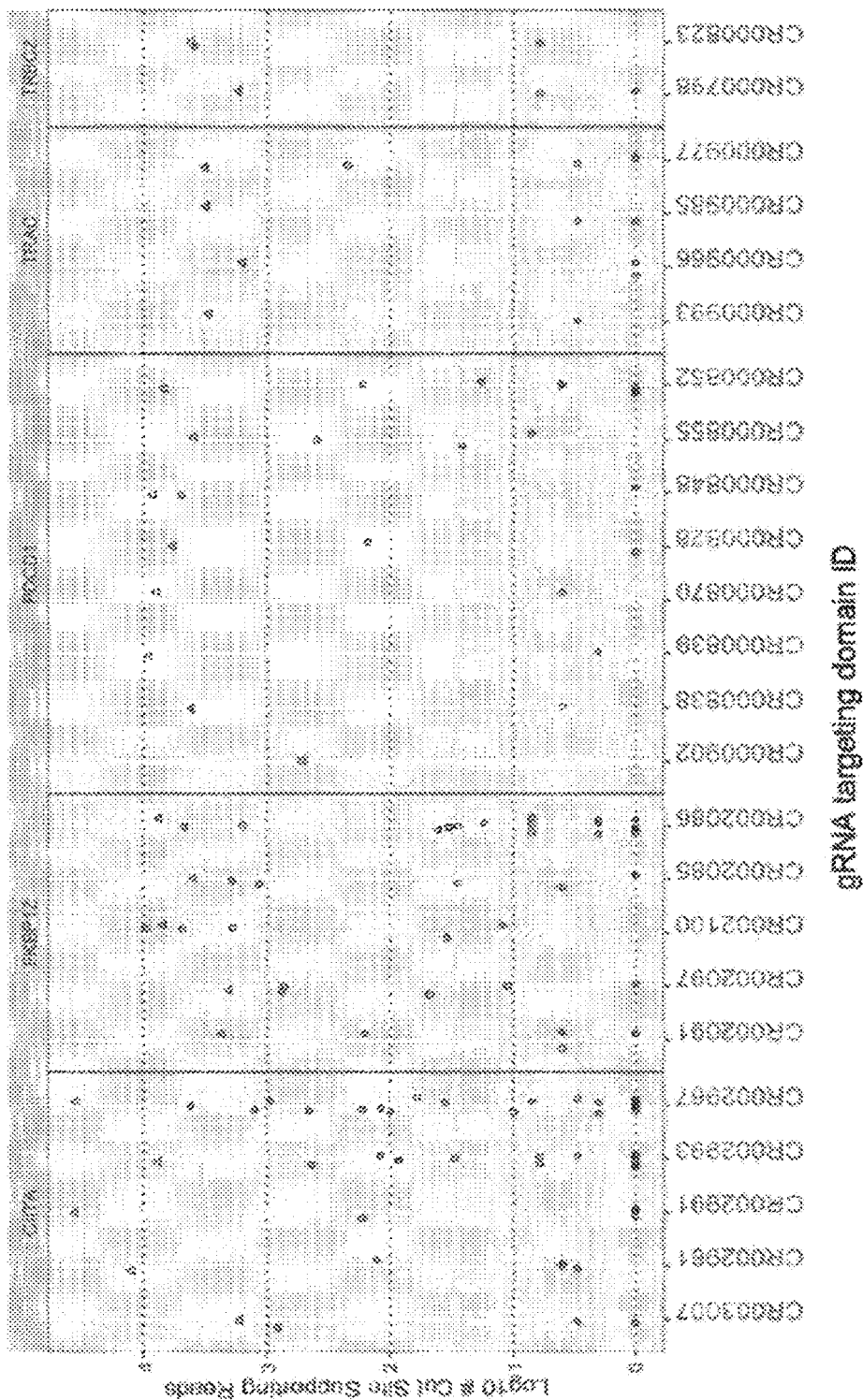
FIG. 64: Off-target activity for CIITA-, FKBP1A-, PDCD1-, TRAC- and TRBC2-targeting guide RNA molecules was assessed using an dsDNA oligo-insertion method in Cas9 overexpressing HEK-293 cells. The on-target site (triangle) and the potential off-target sites (circles) detected are indicated; y-axis indicates frequency of detection. All gRNAs were tested in dgRNA format with the targeting domain indicated by the CRxxxxx identifier.

An oligo insertion based assay (See, e.g., Tsai et al., *Nature Biotechnology*. 33, 187-197; 2015) was used to determine potential off-target genomic sites cleaved by Cas9 targeting B2M TRAC, TRBC2, PDCD1, CIITA, and FKBP1A. A total of 34 guideRNAs (dual guide RNAs comprising the indicated targeting domain, modified or unmodified, as indicated) targeting B2M (5), TRAC (9), TRBC2 (2), PDCD1 (8), FKBP1A (5), or CIITA (5) were screened in the Cas9-expressing HEK293 cells described above in Example 1, and the results are plotted in FIG. 63 and FIG. 64. The assay detected high-efficiency editing at the expected target sequences. No off-target editing was observed for the B2M-targeting gRNA comprising the targeting domain of CR00444 or the targeting domain of CR00441, and only a single very low-efficiency off-target edit was detected using the B2M-targeting gRNA comprising the targeting domain of CR00442. The results show that for gRNAs targeting TRAC comprising the targeting domain of CR00961, CR00978, CR00984, CR00991 and CR00992, each resulted in high-efficiency editing of the target sequence without editing at any off-target location. As well, no off-target editing was detected for the PDCD1-targeting gRNA comprising the targeting domain of CR00902. With respect to gRNA molecules which demonstrated potential off-target editing in this assay, deep sequencing will be used to determine whether the potential sites are bona fide off-target sites cleaved by Cas9. As well, any potential off-target edit will be assessed for presence and frequency in T-cells.

Example 18: Editing of CD3 Delta and CD3 Gamma in Primary Human CD3+ Cells

Editing of CRISPR systems containing dgRNA molecules comprising targeting domains to sequences of CD3 delta and CD3 gamma were tested for editing in primary CD3+ T cells (gRNA/Cas9 RNP delivered by electroporation) according to the methods described herein. Surface expression of CD3 after editing was assayed by flow cytometry. Briefly, edited CD3+ cells were stained with antibodies against CD3 (OKT3, BioLegend) at day 7 post-electroporation. Expression of CD3 in live cells (identified using 7AAD exclusion) relative to the un-edited controls was used to determine frequency of RNP editing. The results are reported in FIG. 65 and FIG. 66, which include flow cytometry data showing the % editing in primary human CD3+ T cells as measured by loss of surface expression of CD3. Notably, the dgRNA comprising the targeting domain of CR005334 resulted in 98% loss of CD3.

The present invention is not to be limited in scope by the exemplified constructs, since the exemplified embodiments are intended to illustrate only certain aspects of the invention and any constructs that are functionally equivalent are within the scope of this invention. Various modifications of the invention in addition to those shown and described herein will become apparent to those skilled in the art from the foregoing description and fall within the scope of the appended claims.

It is understood that the application of the teachings of the present invention to a specific problem or situation will be within the capabilities of one having ordinary skill in the art in light of the teachings contained herein.

The disclosures of each and every citation in the specification are expressly incorporated herein by reference.

This application is being filed with a sequence listing. To the extent there are any discrepancies between the sequence listing and any sequence recited in the specification, the sequence recited in the specification should be considered the correct sequence. Unless otherwise indicated, all genomic locations are according to hg38.

LENGTHY TABLES

The patent contains a lengthy table section. A copy of the table is available in electronic form from the USPTO web site (https://seqdata.uspto.gov/?pageRequest=docDetail&DocID=US12037583B2). An electronic copy of the table will also be available from the USPTO upon request and payment of the fee set forth in 37 CFR 1.19(b)(3).

SEQUENCE LISTING (11159 sequences)

SEQ ID NO: 1 - RNA, 25 nt, Homo sapiens
uggcugggcacgcguuuaauauaag

SEQ ID NO: 2 - RNA, 25 nt, Homo sapiens
cugggcacgcguuuaauauaagugg

SEQ ID NO: 3 - RNA, 25 nt, Homo sapiens
uuuaauauaaguggaggcgucgcgc

SEQ ID NO: 4 - RNA, 25 nt, Homo sapiens
aauauaaguggaggcgucgcgcugg

SEQ ID NO: 5 - RNA, 25 nt, Homo sapiens
auauaaguggaggcgucgcgcuggc

SEQ ID NO: 6 - RNA, 25 nt, Homo sapiens
gggcauuccugaagcugacagcauu

SEQ ID NO: 7 - RNA, 25 nt, Homo sapiens
ggcauuccugaagcugacagcauuc

SEQ ID NO: 8 - RNA, 25 nt, Homo sapiens
auucgggccgagaugucucgcuccg

SEQ ID NO: 9 - RNA, 25 nt, Homo sapiens
cugugcucgcgcuacucucucuuuc

SEQ ID NO: 10 - RNA, 25 nt, Homo sapiens
cucgcgcuacucucucuuucuggcc

SEQ ID NO: 11 - RNA, 25 nt, Homo sapiens
gcgcuacucucucuuucuggccugg

SEQ ID NO: 12 - RNA, 25 nt, Homo sapiens
auauuaaacgcgugcccagccaauc

SEQ ID NO: 13 - RNA, 25 nt, Homo sapiens
ucucggcccgaaugcugucagcuuc

SEQ ID NO: 14 - RNA, 25 nt, Homo sapiens
gcuaaggccacggagcgagacaucu

SEQ ID NO: 15 - RNA, 25 nt, Homo sapiens
aguagcgcgagcacagcuaaggcca

SEQ ID NO: 16 - RNA, 25 nt, Homo sapiens
agagagaguagcgcgagcacagcua

SEQ ID NO: 17 - RNA, 25 nt, Homo sapiens
gagagacucacgcuggauagccucc

SEQ ID NO: 18 - RNA, 25 nt, Homo sapiens
gcgggaggguaggagagacucacgc

SEQ ID NO: 19 - RNA, 25 nt, Homo sapiens
uauuccucagguacuccaaagauuc

SEQ ID NO: 20 - RNA, 25 nt, Homo sapiens
uuuacucacgucauccagcagagaa

SEQ ID NO: 21 - RNA, 25 nt, Homo sapiens
caaauuuccugaauugcuauguguc

SEQ ID NO: 22 - RNA, 25 nt, Homo sapiens
aaauuuccugaauugcuaugugucu

SEQ ID NO: 23 - RNA, 25 nt, Homo sapiens
acauugaaguugacuuacugaagaa

SEQ ID NO: 24 - RNA, 25 nt, Homo sapiens
aagaauggagagagaauugaaaaag

SEQ ID NO: 25 - RNA, 25 nt, Homo sapiens
gagcauucagacuugucuuucagca

SEQ ID NO: 26 - RNA, 25 nt, Homo sapiens
uucagacuugucuuucagcaaggac

SEQ ID NO: 27 - RNA, 25 nt, Homo sapiens
uuugucacagcccaagauaguuaag

SEQ ID NO: 28 - RNA, 25 nt, Homo sapiens
uugucacagcccaagauaguuaagu

SEQ ID NO: 29 - RNA, 25 nt, Homo sapiens
ugucacagcccaagauaguuaagug

SEQ ID NO: 30 - RNA, 25 nt, Homo sapiens
aucuuuggaguaccugaggaauauc

SEQ ID NO: 31 - RNA, 25 nt, Homo sapiens
aaucuuuggaguaccugaggaauau

SEQ ID NO: 32 - RNA, 25 nt, Homo sapiens
uaaaccugaaucuuuggaguaccug

SEQ ID NO: 33 - RNA, 25 nt, Homo sapiens
gaugacgugaguaaaccugaaucuu

SEQ ID NO: 34 - RNA, 25 nt, Homo sapiens
ggaaauuugacuuuccauucucugc

SEQ ID NO: 35 - RNA, 25 nt, Homo sapiens
augaaacccagacacauagcaauuc

SEQ ID NO: 36 - RNA, 25 nt, Homo sapiens
ucaguaagucaacuucaaugucgga

SEQ ID NO: 37 - RNA, 25 nt, Homo sapiens
uucuucaguaagucaacuucaaugu

SEQ ID NO: 38 - RNA, 25 nt, Homo sapiens
caggcauacucaucuuuuucagugg

SEQ ID NO: 39 - RNA, 25 nt, Homo sapiens
gcaggcauacucaucuuuuucagug

SEQ ID NO: 40 - RNA, 25 nt, Homo sapiens
ggcaggcauacucaucuuuuucagu

SEQ ID NO: 41 - RNA, 25 nt, Homo sapiens
cggcaggcauacucaucuuuuucag

SEQ ID NO: 42 - RNA, 25 nt, Homo sapiens
gacaaagucacaugguucacacggc

SEQ ID NO: 43 - RNA, 25 nt, Homo sapiens
cugugacaaagucacaugguucaca

SEQ ID NO: 44 - RNA, 25 nt, Homo sapiens
uaucuugggcugugacaaagucaca

SEQ ID NO: 45 - RNA, 25 nt, Homo sapiens
aagacuuaccccacuuaacuaucuu

SEQ ID NO: 46 - RNA, 25 nt, Homo sapiens
uaagacuuaccccacuuaacuaucu

SEQ ID NO: 47 - RNA, 25 nt, Homo sapiens
agaucgagacauguaagcagcauca

SEQ ID NO: 48 - RNA, 25 nt, Homo sapiens
ucgagacauguaagcagcaucaugg

SEQ ID NO: 49 - RNA, 25 nt, Homo sapiens
augucucgaucuaugaaaaagacag

SEQ ID NO: 50 - RNA, 25 nt, Homo sapiens
uuuucagguuugaagaugccgcauu

SEQ ID NO: 51 - RNA, 25 nt, Homo sapiens
agguuugaagaugccgcauuuggau

SEQ ID NO: 52 - RNA, 25 nt, Homo sapiens
cacuuacacuuuaugcacaaaaugu

SEQ ID NO: 53 - RNA, 25 nt, Homo sapiens
acuuacacuuuaugcacaaaaugua

SEQ ID NO: 54 - RNA, 25 nt, Homo sapiens
auguaggguuauaauaauguuaaca

SEQ ID NO: 55 - RNA, 25 nt, Homo sapiens
gucuccauguuugauguaucugagc

SEQ ID NO: 56 - RNA, 25 nt, Homo sapiens
gauguaucugagcagguugcuccac

SEQ ID NO: 57 - RNA, 25 nt, Homo sapiens
agcagguugcuccacagguagcucu

SEQ ID NO: 58 - RNA, 25 nt, Homo sapiens
agguugcuccacagguagcucuagg

SEQ ID NO: 59 - RNA, 25 nt, Homo sapiens
gguugcuccacagguagcucuagga

SEQ ID NO: 60 - RNA, 25 nt, Homo sapiens
gcuccacagguagcucuaggagggc

SEQ ID NO: 61 - RNA, 25 nt, Homo sapiens
agcucuaggagggcuggcaacuuag

SEQ ID NO: 62 - RNA, 25 nt, Homo sapiens
ucuaggagggcuggcaacuuagagg

SEQ ID NO: 63 - RNA, 25 nt, Homo sapiens
cuaggagggcuggcaacuuagaggu

SEQ ID NO: 64 - RNA, 25 nt, Homo sapiens
uaggagggcuggcaacuuagaggug

SEQ ID NO: 65 - RNA, 25 nt, Homo sapiens
auucucuuauccaacaucaacaucu

SEQ ID NO: 66 - RNA, 25 nt, Homo sapiens
caauuuacauacucugcuuagaauu

SEQ ID NO: 67 - RNA, 25 nt, Homo sapiens
aauuuacauacucugcuuagaauuu

SEQ ID NO: 68 - RNA, 25 nt, Homo sapiens
auuuacauacucugcuuagaauuug

SEQ ID NO: 69 - RNA, 25 nt, Homo sapiens
uuuacauacucugcuuagaauuugg

SEQ ID NO: 70 - RNA, 25 nt, Homo sapiens
gggaaaauuuagaaauauaauugac

SEQ ID NO: 71 - RNA, 25 nt, Homo sapiens
uuagaaauauaauugacaggauuau

SEQ ID NO: 72 - RNA, 25 nt, Homo sapiens
uacuucuuauacauuugauaaagua

SEQ ID NO: 73 - RNA, 25 nt, Homo sapiens
cuuauacauuugauaaaguaaggca

SEQ ID NO: 74 - RNA, 25 nt, Homo sapiens
cauuugauaaaguaaggcaugguug

SEQ ID NO: 75 - RNA, 25 nt, Homo sapiens
aaguaaggcaugguugugguuaauc

SEQ ID NO: 76 - RNA, 25 nt, Homo sapiens
cuucaaaccugaaaagaaaagaaaa

SEQ ID NO: 77 - RNA, 25 nt, Homo sapiens
auuuggaauucauccaauccaaaug

SEQ ID NO: 78 - RNA, 25 nt, Homo sapiens
uauuaaaaagcaagcaagcagaauu

SEQ ID NO: 79 - RNA, 25 nt, Homo sapiens
gcaaccugcucagauacaucaaaca

SEQ ID NO: 80 - RNA, 25 nt, Homo sapiens
uugccagcccuccuagagcuaccug

SEQ ID NO: 81 - RNA, 25 nt, Homo sapiens
ucaaaucugaccaagauguugaugu

SEQ ID NO: 82 - RNA, 25 nt, Homo sapiens
caaauucuaagcagaguauguaaau

SEQ ID NO: 83 - RNA, 25 nt, Homo sapiens
caaguuuuaugauuuauuuaacuug

SEQ ID NO: 84 - RNA, 25 nt, Homo sapiens
cacugaagcauuuauuaugcaaaau

SEQ ID NO: 85 - RNA, 25 nt, Homo sapiens
gaagcauuuauuaugcaaaauagga

SEQ ID NO: 86 - RNA, 25 nt, Homo sapiens
cagaguagagagcguuuuccaucca

SEQ ID NO: 87 - RNA, 25 nt, Homo sapiens
acgcagcaguauccuaguacauuga

SEQ ID NO: 88 - RNA, 25 nt, Homo sapiens
cgcagcaguauccuaguacauugac

SEQ ID NO: 89 - RNA, 25 nt, Homo sapiens
uuuuuccuguccugccacuguccgc

SEQ ID NO: 90 - RNA, 25 nt, Homo sapiens
uuuuccuguccugccacuguccgcu

SEQ ID NO: 91 - RNA, 25 nt, Homo sapiens
cugccacuguccgcugggcaguuau

SEQ ID NO: 92 - RNA, 25 nt, Homo sapiens
cugggcaguuauaggucccaugugu

SEQ ID NO: 93 - RNA, 25 nt, Homo sapiens
ugggcaguuauaggucccauguguu

SEQ ID NO: 94 - RNA, 25 nt, Homo sapiens
gucccauguguugggucuuccugcg

SEQ ID NO: 95 - RNA, 25 nt, Homo sapiens
ucgcugaaagcgugaagugaaucaa

SEQ ID NO: 96 - RNA, 25 nt, Homo sapiens
augccacuuugugcacagcucauca

SEQ ID NO: 97 - RNA, 25 nt, Homo sapiens
caucaaggucagucuguucaucuuc

SEQ ID NO: 98 - RNA, 25 nt, Homo sapiens
uucaucuucuggccccuguagcaca

SEQ ID NO: 99 - RNA, 25 nt, Homo sapiens
cccuguagcacaugguacaguucaa

SEQ ID NO: 100 - RNA, 25 nt, Homo sapiens
uagcacaugguacaguucaauggug

SEQ ID NO: 101 - RNA, 25 nt, Homo sapiens
gguacaguucaauggugcggcacag

SEQ ID NO: 102 - RNA, 25 nt, Homo sapiens
uucaauggugcggcacagaggccug

SEQ ID NO: 103 - RNA, 25 nt, Homo sapiens
auggugcggcacagaggccugaggc

SEQ ID NO: 104 - RNA, 25 nt, Homo sapiens
uggugcggcacagaggccugaggca

SEQ ID NO: 105 - RNA, 25 nt, Homo sapiens
ugcggcacagaggccugaggcaggg

SEQ ID NO: 106 - RNA, 25 nt, Homo sapiens
gcagggaggcucccgcugcccucgc

SEQ ID NO: 107 - RNA, 25 nt, Homo sapiens
aggcucccgcugcccucgcaggccc

SEQ ID NO: 108 - RNA, 25 nt, Homo sapiens
accuucccaugccccugcagcuccc

SEQ ID NO: 109 - RNA, 25 nt, Homo sapiens
gccccugcagcucccugguugcacc

SEQ ID NO: 110 - RNA, 25 nt, Homo sapiens
gcagcucccugguugcaccuggccu

SEQ ID NO: 111 - RNA, 25 nt, Homo sapiens
gcuccuuuccaucugccccucugcc

SEQ ID NO: 112 - RNA, 25 nt, Homo sapiens
ugccccucugcccggcccucucacc

SEQ ID NO: 113 - RNA, 25 nt, Homo sapiens
gccccucugcccggcccucucacca

SEQ ID NO: 114 - RNA, 25 nt, Homo sapiens
ccucugcccggcccucucaccaggg

SEQ ID NO: 115 - RNA, 25 nt, Homo sapiens
gcccucucaccagggaggcacaaca

SEQ ID NO: 116 - RNA, 25 nt, Homo sapiens
cauggcccaguacaguuaccuugaa

SEQ ID NO: 117 - RNA, 25 nt, Homo sapiens
ggcccaguacaguuaccuugaaagg

SEQ ID NO: 118 - RNA, 25 nt, Homo sapiens
guacaguuaccuugaaaggagguga

SEQ ID NO: 119 - RNA, 25 nt, Homo sapiens
ugacaacagaagccaaauuuacagc

SEQ ID NO: 120 - RNA, 25 nt, Homo sapiens
ucagacacagagugauacagacauu

SEQ ID NO: 121 - RNA, 25 nt, Homo sapiens
cagacacagagugauacagacauua

SEQ ID NO: 122 - RNA, 25 nt, Homo sapiens
caugugcuagcaucugcgcuuucuc

SEQ ID NO: 123 - RNA, 25 nt, Homo sapiens
augugcuagcaucugcgcuuucucu

SEQ ID NO: 124 - RNA, 25 nt, Homo sapiens
ugugcuagcaucugcgcuuucucug

SEQ ID NO: 125 - RNA, 25 nt, Homo sapiens
acagacucaacaacucagcugugag

SEQ ID NO: 126 - RNA, 25 nt, Homo sapiens
gugagaggcagugcgcccgccuccc

SEQ ID NO: 127 - RNA, 25 nt, Homo sapiens
ugagaggcagugcgcccgccuccca

SEQ ID NO: 128 - RNA, 25 nt, Homo sapiens
gugcgcccgccucccagggagaacg

SEQ ID NO: 129 - RNA, 25 nt, Homo sapiens
cucccagggagaacgaggaaccgcc

SEQ ID NO: 130 - RNA, 25 nt, Homo sapiens
ggagaacgaggaaccgccaggagac

SEQ ID NO: 131 - RNA, 25 nt, Homo sapiens
caggagacaggucuaccugcaccac

SEQ ID NO: 132 - RNA, 25 nt, Homo sapiens
ucuaccugcaccaccggcaaaccag

SEQ ID NO: 133 - RNA, 25 nt, Homo sapiens
cuaccugcaccaccggcaaaccaga

SEQ ID NO: 134 - RNA, 25 nt, Homo sapiens
caccaccggcaaaccagagggccca

SEQ ID NO: 135 - RNA, 25 nt, Homo sapiens
ccggcaaaccagagggcccaaggcc

SEQ ID NO: 136 - RNA, 25 nt, Homo sapiens
cggcaaaccagagggcccaaggcca

SEQ ID NO: 137 - RNA, 25 nt, Homo sapiens
ggcccaaggccagggccguaagccc

SEQ ID NO: 138 - RNA, 25 nt, Homo sapiens
gcccaaggccagggccguaagcccu

SEQ ID NO: 139 - RNA, 25 nt, Homo sapiens
gggaguacacucccuuaaagagugc

SEQ ID NO: 140 - RNA, 25 nt, Homo sapiens
ggaguacacucccuuaaagagugca

SEQ ID NO: 141 - RNA, 25 nt, Homo sapiens
ugcagggacaacagucuguguguga

SEQ ID NO: 142 - RNA, 25 nt, Homo sapiens
ggacaacagucugugugugaagguu

SEQ ID NO: 143 - RNA, 25 nt, Homo sapiens
uauaaccaaagcauccuguacauaa

SEQ ID NO: 144 - RNA, 25 nt, Homo sapiens
auaaccaaagcauccuguacauaaa

SEQ ID NO: 145 - RNA, 25 nt, Homo sapiens
uaaccaaagcauccuguacauaaag

SEQ ID NO: 146 - RNA, 25 nt, Homo sapiens
cuguacauaaaggggaauacuucag

SEQ ID NO: 147 - RNA, 25 nt, Homo sapiens
acuucaguggcugagaagagugaac

SEQ ID NO: 148 - RNA, 25 nt, Homo sapiens
cuucaguggcugagaagagugaacc

SEQ ID NO: 149 - RNA, 25 nt, Homo sapiens
augcuucauccugugucucauaauc

SEQ ID NO: 150 - RNA, 25 nt, Homo sapiens
ugcuucauccugugucucauaaucu

SEQ ID NO: 151 - RNA, 25 nt, Homo sapiens
ugugucucauaaucugggcgucugc

SEQ ID NO: 152 - RNA, 25 nt, Homo sapiens
cucauaaucugggcgucugcagguc

SEQ ID NO: 153 - RNA, 25 nt, Homo sapiens
ggcgucugcaggucuggccuuugag

SEQ ID NO: 154 - RNA, 25 nt, Homo sapiens
cuggccuuugaguggugaaaucccc

SEQ ID NO: 155 - RNA, 25 nt, Homo sapiens
uggugaaauccccuggcuguuagcg

SEQ ID NO: 156 - RNA, 25 nt, Homo sapiens
ggugaaauccccuggcuguuagcga

SEQ ID NO: 157 - RNA, 25 nt, Homo sapiens
gugaaauccccuggcuguuagcgag

SEQ ID NO: 158 - RNA, 25 nt, Homo sapiens
ugaaauccccuggcuguuagcgagg

SEQ ID NO: 159 - RNA, 25 nt, Homo sapiens
auccccuggcuguuagcgagggggc

SEQ ID NO: 160 - RNA, 25 nt, Homo sapiens
uccccuggcuguuagcgagggggca

SEQ ID NO: 161 - RNA, 25 nt, Homo sapiens
gcgagggggcagggccugcauguga

SEQ ID NO: 162 - RNA, 25 nt, Homo sapiens
cgagggggcagggccugcaugugaa

SEQ ID NO: 163 - RNA, 25 nt, Homo sapiens
agggccugcaugugaagggcgucgu

SEQ ID NO: 164 - RNA, 25 nt, Homo sapiens
augugaagggcgucguagguguccu

SEQ ID NO: 165 - RNA, 25 nt, Homo sapiens
ugaagggcgucguagguguccuugg

SEQ ID NO: 166 - RNA, 25 nt, Homo sapiens
guccuugguggcuguacugagaccc

SEQ ID NO: 167 - RNA, 25 nt, Homo sapiens
uuuuuucuacuguuuuaauuuauac

SEQ ID NO: 168 - RNA, 25 nt, Homo sapiens
gucauuacagggcacaggccaugga

SEQ ID NO: 169 - RNA, 25 nt, Homo sapiens
cugcgucauuacagggcacaggcca

SEQ ID NO: 170 - RNA, 25 nt, Homo sapiens
auacugcugcgucauuacagggcac

SEQ ID NO: 171 - RNA, 25 nt, Homo sapiens
acuaggauacugcugcgucauuaca

SEQ ID NO: 172 - RNA, 25 nt, Homo sapiens
uacuaggauacugcugcgucauuac

SEQ ID NO: 173 - RNA, 25 nt, Homo sapiens
gacaggaaaaacccgucaauguacu

SEQ ID NO: 174 - RNA, 25 nt, Homo sapiens
acugcccagcggacaguggcaggac

SEQ ID NO: 175 - RNA, 25 nt, Homo sapiens
cuauaacugcccagcggacaguggc

SEQ ID NO: 176 - RNA, 25 nt, Homo sapiens
ggaccuauaacugcccagcggacag

SEQ ID NO: 177 - RNA, 25 nt, Homo sapiens
acacaugggaccuauaacugcccag

SEQ ID NO: 178 - RNA, 25 nt, Homo sapiens
ggccucgcaggaagacccaacacau

SEQ ID NO: 179 - RNA, 25 nt, Homo sapiens
aggccucgcaggaagacccaacaca

SEQ ID NO: 180 - RNA, 25 nt, Homo sapiens
aaaaucaucuuugugaaggccucgc

SEQ ID NO: 181 - RNA, 25 nt, Homo sapiens
gcgaaugacaaaaucaucuuuguga

SEQ ID NO: 182 - RNA, 25 nt, Homo sapiens
gaauaaagugcugcggagcaagagg

SEQ ID NO: 183 - RNA, 25 nt, Homo sapiens
ugugaauaaagugcugcggagcaag

SEQ ID NO: 184 - RNA, 25 nt, Homo sapiens
guuacacagugugaauaaagugcug

SEQ ID NO: 185 - RNA, 25 nt, Homo sapiens
ugcacaaaguggcauaaaaaacaug

SEQ ID NO: 186 - RNA, 25 nt, Homo sapiens
ugaccuugaugagcugugcacaaag

SEQ ID NO: 187 - RNA, 25 nt, Homo sapiens
cauugaacuguaccaugugcuacag

SEQ ID NO: 188 - RNA, 25 nt, Homo sapiens
ccauugaacuguaccaugugcuaca

SEQ ID NO: 189 - RNA, 25 nt, Homo sapiens
accauugaacuguaccaugugcuac

SEQ ID NO: 190 - RNA, 25 nt, Homo sapiens
agggcagcgggagccucccugccuc

SEQ ID NO: 191 - RNA, 25 nt, Homo sapiens
gucagccagggccugcgagggcagc

SEQ ID NO: 192 - RNA, 25 nt, Homo sapiens
ggucagccagggccugcgagggcag

SEQ ID NO: 193 - RNA, 25 nt, Homo sapiens
ggggagggucagccagggccugcga

SEQ ID NO: 194 - RNA, 25 nt, Homo sapiens
aggggagggucagccagggccugcg

SEQ ID NO: 195 - RNA, 25 nt, Homo sapiens
ugggcgggcaggggagggucagcca

SEQ ID NO: 196 - RNA, 25 nt, Homo sapiens
gugggcgggcaggggagggucagcc

SEQ ID NO: 197 - RNA, 25 nt, Homo sapiens
caugggaaggugggcgggcagggga

SEQ ID NO: 198 - RNA, 25 nt, Homo sapiens
gcaugggaaggugggcgggcagggg

SEQ ID NO: 199 - RNA, 25 nt, Homo sapiens
ggggcaugggaaggugggcgggcag

SEQ ID NO: 200 - RNA, 25 nt, Homo sapiens
aggggcaugggaaggugggcgggca

SEQ ID NO: 201 - RNA, 25 nt, Homo sapiens
caggggcaugggaaggugggcgggc

SEQ ID NO: 202 - RNA, 25 nt, Homo sapiens
gcugcaggggcaugggaaggugggc

SEQ ID NO: 203 - RNA, 25 nt, Homo sapiens
agcugcaggggcaugggaagguggg

SEQ ID NO: 204 - RNA, 25 nt, Homo sapiens
gggagcugcaggggcaugggaaggu

SEQ ID NO: 205 - RNA, 25 nt, Homo sapiens
agggagcugcaggggcaugggaagg

SEQ ID NO: 206 - RNA, 25 nt, Homo sapiens
accagggagcugcaggggcauggga

SEQ ID NO: 207 - RNA, 25 nt, Homo sapiens
ugcaaccagggagcugcaggggcau

SEQ ID NO: 208 - RNA, 25 nt, Homo sapiens
gugcaaccagggagcugcaggggca

SEQ ID NO: 209 - RNA, 25 nt, Homo sapiens
gccaggugcaaccagggagcugcag

SEQ ID NO: 210 - RNA, 25 nt, Homo sapiens
ggccaggugcaaccagggagcugca

SEQ ID NO: 211 - RNA, 25 nt, Homo sapiens
aggccaggugcaaccagggagcugc

SEQ ID NO: 212 - RNA, 25 nt, Homo sapiens
aaggagccuaggccaggugcaacca

SEQ ID NO: 213 - RNA, 25 nt, Homo sapiens
aaaggagccuaggccaggugcaacc

SEQ ID NO: 214 - RNA, 25 nt, Homo sapiens
gggcagauggaaaggagccuaggcc

SEQ ID NO: 215 - RNA, 25 nt, Homo sapiens
cagaggggcagauggaaaggagccu

SEQ ID NO: 216 - RNA, 25 nt, Homo sapiens
gggccgggcagaggggcagauggaa

SEQ ID NO: 217 - RNA, 25 nt, Homo sapiens
ugagagggccgggcagaggggcaga

SEQ ID NO: 218 - RNA, 25 nt, Homo sapiens
ucccuggugagagggccgggcagag

SEQ ID NO: 219 - RNA, 25 nt, Homo sapiens
cucccuggugagagggccgggcaga

SEQ ID NO: 220 - RNA, 25 nt, Homo sapiens
ccucccuggugagagggccgggcag

SEQ ID NO: 221 - RNA, 25 nt, Homo sapiens
guugugccucccuggugagagggcc

SEQ ID NO: 222 - RNA, 25 nt, Homo sapiens
uguugugccucccuggugagagggc

SEQ ID NO: 223 - RNA, 25 nt, Homo sapiens
gccauguugugccucccuggugaga

SEQ ID NO: 224 - RNA, 25 nt, Homo sapiens
ggccauguugugccucccuggugag

SEQ ID NO: 225 - RNA, 25 nt, Homo sapiens
uguacugggccauguugugccuccc

SEQ ID NO: 226 - RNA, 25 nt, Homo sapiens
caccuccuuucaagguaacuguacu

SEQ ID NO: 227 - RNA, 25 nt, Homo sapiens
ucaccuccuuucaagguaacuguac

SEQ ID NO: 228 - RNA, 25 nt, Homo sapiens
cuguugucaccuucaccuccuuuca

SEQ ID NO: 229 - RNA, 25 nt, Homo sapiens
aguggcuucacuccugcuguaaauu

SEQ ID NO: 230 - RNA, 25 nt, Homo sapiens
augucuguaucacucugugucugag

SEQ ID NO: 231 - RNA, 25 nt, Homo sapiens
cgguuccucguucucccugggaggc

SEQ ID NO: 232 - RNA, 25 nt, Homo sapiens
gcgguuccucguucucccugggagg

SEQ ID NO: 233 - RNA, 25 nt, Homo sapiens
cuggcgguuccucguucucccuggg

SEQ ID NO: 234 - RNA, 25 nt, Homo sapiens
cuccuggcgguuccucguucucccu

SEQ ID NO: 235 - RNA, 25 nt, Homo sapiens
ucuccuggcgguuccucguucuccc

SEQ ID NO: 236 - RNA, 25 nt, Homo sapiens
uggugcagguagaccugucuccugg

SEQ ID NO: 237 - RNA, 25 nt, Homo sapiens
cgguggugcagguagaccugucucc

SEQ ID NO: 238 - RNA, 25 nt, Homo sapiens
gggcccucugguuugccgguggugc

SEQ ID NO: 239 - RNA, 25 nt, Homo sapiens
ggccuugggcccucugguuugccgg

SEQ ID NO: 240 - RNA, 25 nt, Homo sapiens
ccuggccuugggcccucugguuugc

SEQ ID NO: 241 - RNA, 25 nt, Homo sapiens
cuuacggcccuggccuugggcccuc

SEQ ID NO: 242 - RNA, 25 nt, Homo sapiens
ucccagggcuuacggcccuggccuu

SEQ ID NO: 243 - RNA, 25 nt, Homo sapiens
cucccagggcuuacggcccuggccu

SEQ ID NO: 244 - RNA, 25 nt, Homo sapiens
aguguacucccagggcuuacggccc

SEQ ID NO: 245 - RNA, 25 nt, Homo sapiens
uaagggaguguacucccagggcuua

SEQ ID NO: 246 - RNA, 25 nt, Homo sapiens
cacucuuuaagggaguguacuccca

SEQ ID NO: 247 - RNA, 25 nt, Homo sapiens
gcacucuuuaagggaguguacuccc

SEQ ID NO: 248 - RNA, 25 nt, Homo sapiens
agacuguugucccugcacucuuuaa

SEQ ID NO: 249 - RNA, 25 nt, Homo sapiens
cagacuguugucccugcacucuuua

SEQ ID NO: 250 - RNA, 25 nt, Homo sapiens
auuccccuuuauguacaggaugcuu

SEQ ID NO: 251 - RNA, 25 nt, Homo sapiens
cacugaaguauuccccuuuauguac

SEQ ID NO: 252 - RNA, 25 nt, Homo sapiens
gacacaggaugaagcauuuacaacc

SEQ ID NO: 253 - RNA, 25 nt, Homo sapiens
ugcagacgcccagauuaugagacac

SEQ ID NO: 254 - RNA, 25 nt, Homo sapiens
acagccaggggauuucaccacucaa

SEQ ID NO: 255 - RNA, 25 nt, Homo sapiens
gcccugcccccucgcuaacagccag

SEQ ID NO: 256 - RNA, 25 nt, Homo sapiens
ggcccugcccccucgcuaacagcca

SEQ ID NO: 257 - RNA, 25 nt, Homo sapiens
aggcccugcccccucgcuaacagcc

SEQ ID NO: 258 - RNA, 25 nt, Homo sapiens
gacaccuacgacgcccuucacaugc

SEQ ID NO: 259 - RNA, 25 nt, Homo sapiens
cgccagggucucaguacagccacca

SEQ ID NO: 260 - RNA, 25 nt, Homo sapiens
ugaagggacgccggcagcuccuacc

SEQ ID NO: 261 - RNA, 25 nt, Homo sapiens
gacgccggcagcuccuaccugguaa

SEQ ID NO: 262 - RNA, 25 nt, Homo sapiens
aaggccaucgugccccuugccccuc

SEQ ID NO: 263 - RNA, 25 nt, Homo sapiens
aucgugccccuugccccuccggcgc

SEQ ID NO: 264 - RNA, 25 nt, Homo sapiens
ccuugccccuccggcgcugguuguu

SEQ ID NO: 265 - RNA, 25 nt, Homo sapiens
cuugccccuccggcgcugguuguuu

SEQ ID NO: 266 - RNA, 25 nt, Homo sapiens
auggccuuuaccagguaggagcugc

SEQ ID NO: 267 - RNA, 25 nt, Homo sapiens
aggggcacgauggccuuuaccaggu

SEQ ID NO: 268 - RNA, 25 nt, Homo sapiens
ggcaaggggcacgauggccuuuacc

SEQ ID NO: 269 - RNA, 25 nt, Homo sapiens
agcgccggaggggcaaggggcacga

SEQ ID NO: 270 - RNA, 25 nt, Homo sapiens
aaacaaccagcgccggaggggcaag

SEQ ID NO: 271 - RNA, 25 nt, Homo sapiens
caaacaaccagcgccggaggggcaa

SEQ ID NO: 272 - RNA, 25 nt, Homo sapiens
ccaaacaaccagcgccggaggggca

SEQ ID NO: 273 - RNA, 25 nt, Homo sapiens
cacucccaaacaaccagcgccggag

SEQ ID NO: 274 - RNA, 25 nt, Homo sapiens
ucacucccaaacaaccagcgccgga

SEQ ID NO: 275 - RNA, 25 nt, Homo sapiens
uucacucccaaacaaccagcgccgg

SEQ ID NO: 276 - RNA, 25 nt, Homo sapiens
cauuucacucccaaacaaccagcgc

SEQ ID NO: 277 - RNA, 25 nt, Homo sapiens
ucgccuuucaucccaaucucacugu

SEQ ID NO: 278 - RNA, 25 nt, Homo sapiens
uaucuuucugcaguuccugcagaag

SEQ ID NO: 279 - RNA, 25 nt, Homo sapiens
aucuuucugcaguuccugcagaaga

SEQ ID NO: 280 - RNA, 25 nt, Homo sapiens
ucugcaguuccugcagaagagggcg

SEQ ID NO: 281 - RNA, 25 nt, Homo sapiens
uacagugagauugggaugaaaggcg

SEQ ID NO: 282 - RNA, 25 nt, Homo sapiens
aggccuacagugagauugggaugaa

SEQ ID NO: 283 - RNA, 25 nt, Homo sapiens
gauggcggaggccuacagugagauu

SEQ ID NO: 284 - RNA, 25 nt, Homo sapiens
agauggcggaggccuacagugagau

SEQ ID NO: 285 - RNA, 25 nt, Homo sapiens
gaacugcagaaagauaagauggcgg

SEQ ID NO: 286 - RNA, 25 nt, Homo sapiens
caggaacugcagaaagauaagaugg

SEQ ID NO: 287 - RNA, 25 nt, Homo sapiens
cugcaggaacugcagaaagauaaga

SEQ ID NO: 288 - RNA, 25 nt, Homo sapiens
gaggucuccucuacucacauuguac

SEQ ID NO: 289 - RNA, 25 nt, Homo sapiens
uacucacauuguacaggccuuccug

SEQ ID NO: 290 - RNA, 25 nt, Homo sapiens
acucacauuguacaggccuuccuga

SEQ ID NO: 291 - RNA, 25 nt, Homo sapiens
uccugaggguucuuccuucucugcu

SEQ ID NO: 292 - RNA, 25 nt, Homo sapiens
cuuccuucucugcuaggaaagacaa

SEQ ID NO: 293 - RNA, 25 nt, Homo sapiens
uuccuucucugcuaggaaagacaac

SEQ ID NO: 294 - RNA, 25 nt, Homo sapiens
aggaaggccuguacaaugugaguag

SEQ ID NO: 295 - RNA, 25 nt, Homo sapiens
agcagagaaggaagaacccucagga

SEQ ID NO: 296 - RNA, 25 nt, Homo sapiens
uccuagcagagaaggaagaacccuc

SEQ ID NO: 297 - RNA, 25 nt, Homo sapiens
uucccguugucuuuccuagcagaga

SEQ ID NO: 298 - RNA, 25 nt, Homo sapiens
cacaggaagguagaggaaccccuac

SEQ ID NO: 299 - RNA, 25 nt, Homo sapiens
ccccuaccggcuuuccccccaucuc

SEQ ID NO: 300 - RNA, 25 nt, Homo sapiens
cccuaccggcuuuccccccaucuca

SEQ ID NO: 301 - RNA, 25 nt, Homo sapiens
cggcuuuccccccaucucagggucc

SEQ ID NO: 302 - RNA, 25 nt, Homo sapiens
ccugagauggggggaaagccgguag

SEQ ID NO: 303 - RNA, 25 nt, Homo sapiens
cccugagauggggggaaagccggua

SEQ ID NO: 304 - RNA, 25 nt, Homo sapiens
acccugagauggggggaaagccggu

SEQ ID NO: 305 - RNA, 25 nt, Homo sapiens
cgggacccugagauggggggaaagc

SEQ ID NO: 306 - RNA, 25 nt, Homo sapiens
gacguggccgggacccugagauggg

SEQ ID NO: 307 - RNA, 25 nt, Homo sapiens
agacguggccgggacccugagaugg

SEQ ID NO: 308 - RNA, 25 nt, Homo sapiens
gagacguggccgggacccugagaug

SEQ ID NO: 309 - RNA, 25 nt, Homo sapiens
agagacguggccgggacccugagau

SEQ ID NO: 310 - RNA, 25 nt, Homo sapiens
aagagacguggccgggacccugaga

SEQ ID NO: 311 - RNA, 25 nt, Homo sapiens
gauguuuuggacaagagacguggcc

SEQ ID NO: 312 - RNA, 25 nt, Homo sapiens
cgauguuuuggacaagagacguggc

SEQ ID NO: 313 - RNA, 25 nt, Homo sapiens
aguacgauguuuuggacaagagacg

SEQ ID NO: 314 - RNA, 25 nt, Homo sapiens
ggacgaagagaggaguacgauguuu

SEQ ID NO: 315 - RNA, 25 nt, Homo sapiens
uaggagcucaaucuaggacgaagag

SEQ ID NO: 316 - RNA, 25 nt, Homo sapiens
cuuaucuguuauaggagcucaaucu

SEQ ID NO: 317 - RNA, 25 nt, Homo sapiens
gcgaggcugacuuacguuauagagc

SEQ ID NO: 318 - RNA, 25 nt, Homo sapiens
cugacuuacguuauagagcugguuc

SEQ ID NO: 319 - RNA, 25 nt, Homo sapiens
guuauagagcugguucuggcccugc

SEQ ID NO: 320 - RNA, 25 nt, Homo sapiens
agcugguucuggcccugcugguacg

SEQ ID NO: 321 - RNA, 25 nt, Homo sapiens
gcugguucuggcccugcugguacgc

SEQ ID NO: 322 - RNA, 25 nt, Homo sapiens
cugguucuggcccugcugguacgcg

SEQ ID NO: 323 - RNA, 25 nt, Homo sapiens
ugguucuggcccugcugguacgcgg

SEQ ID NO: 324 - RNA, 25 nt, Homo sapiens
gcgcagacgcccccgcguaccagca

SEQ ID NO: 325 - RNA, 25 nt, Homo sapiens
agcgcagacgcccccgcguaccagc

SEQ ID NO: 326 - RNA, 25 nt, Homo sapiens
uuugcuuucuguguugcaguucagc

SEQ ID NO: 327 - RNA, 25 nt, Homo sapiens
cccagugguacccaccuucacucuc

SEQ ID NO: 328 - RNA, 25 nt, Homo sapiens
guacccaccuucacucucaggaaca

SEQ ID NO: 329 - RNA, 25 nt, Homo sapiens
agugagaaugacaccauagaugaag

SEQ ID NO: 330 - RNA, 25 nt, Homo sapiens
auagaugaagaggauuccauccagc

SEQ ID NO: 331 - RNA, 25 nt, Homo sapiens
auuccauccagcagguagcagaguu

SEQ ID NO: 332 - RNA, 25 nt, Homo sapiens
uuccauccagcagguagcagaguuu

SEQ ID NO: 333 - RNA, 25 nt, Homo sapiens
cagguagcagaguuugggauccagc

SEQ ID NO: 334 - RNA, 25 nt, Homo sapiens
gugccucugugccaagagauaaagc

SEQ ID NO: 335 - RNA, 25 nt, Homo sapiens
aagguggguaccacugggcuuuggg

SEQ ID NO: 336 - RNA, 25 nt, Homo sapiens
gugaagguggguaccacugggcuuu

SEQ ID NO: 337 - RNA, 25 nt, Homo sapiens
agugaagguggguaccacugggcuu

SEQ ID NO: 338 - RNA, 25 nt, Homo sapiens
ccugagagugaagguggguaccacu

SEQ ID NO: 339 - RNA, 25 nt, Homo sapiens
uccugagagugaagguggguaccac

SEQ ID NO: 340 - RNA, 25 nt, Homo sapiens
cugccuuguuccugagagugaaggu

SEQ ID NO: 341 - RNA, 25 nt, Homo sapiens
acugccuuguuccugagagugaagg

SEQ ID NO: 342 - RNA, 25 nt, Homo sapiens
cucacugccuuguuccugagaguga

SEQ ID NO: 343 - RNA, 25 nt, Homo sapiens
ugcuggauggaauccucuucaucua

SEQ ID NO: 344 - RNA, 25 nt, Homo sapiens
aucccaaacucugcuaccugcugga

SEQ ID NO: 345 - RNA, 25 nt, Homo sapiens
cuggaucccaaacucugcuaccugc

SEQ ID NO: 346 - RNA, 25 nt, Homo sapiens
acagaggcacagagcuuuggccugc

SEQ ID NO: 347 - RNA, 25 nt, Homo sapiens
cucuuggcacagaggcacagagcuu

SEQ ID NO: 348 - RNA, 25 nt, Homo sapiens
ugaccagcuuuaucucuuggcacag

SEQ ID NO: 349 - RNA, 25 nt, Homo sapiens
ucgacacgucggcccuaccuguaau

SEQ ID NO: 350 - RNA, 25 nt, Homo sapiens
accuguaaucggcaacugugccugc

SEQ ID NO: 351 - RNA, 25 nt, Homo sapiens
guaaucggcaacugugccugcagga

SEQ ID NO: 352 - RNA, 25 nt, Homo sapiens
ggcaacugugccugcaggauggccg

SEQ ID NO: 353 - RNA, 25 nt, Homo sapiens
ucaucuuguccuuucccucagaaag

SEQ ID NO: 354 - RNA, 25 nt, Homo sapiens
cuuguccuuucccucagaaagaggc

SEQ ID NO: 355 - RNA, 25 nt, Homo sapiens
uuguccuuucccucagaaagaggcu

SEQ ID NO: 356 - RNA, 25 nt, Homo sapiens
uccuuucccucagaaagaggcuggg

SEQ ID NO: 357 - RNA, 25 nt, Homo sapiens
cccucagaaagaggcugggaggcag

SEQ ID NO: 358 - RNA, 25 nt, Homo sapiens
gaaagaggcugggaggcagaggcug

SEQ ID NO: 359 - RNA, 25 nt, Homo sapiens
ggcugggaggcagaggcugaggcag

SEQ ID NO: 360 - RNA, 25 nt, Homo sapiens
ugggaggcagaggcugaggcagcgg

SEQ ID NO: 361 - RNA, 25 nt, Homo sapiens
aggcagaggcugaggcagcgguggc

SEQ ID NO: 362 - RNA, 25 nt, Homo sapiens
ggcagaggcugaggcagcgguggcc

SEQ ID NO: 363 - RNA, 25 nt, Homo sapiens
gaggcugaggcagcgguggccggga

SEQ ID NO: 364 - RNA, 25 nt, Homo sapiens
ugaggcagcgguggccgggacgguu

SEQ ID NO: 365 - RNA, 25 nt, Homo sapiens
cgguggccgggacgguuaggagaaa

SEQ ID NO: 366 - RNA, 25 nt, Homo sapiens
cgguuaggagaaaaggagucucugc

SEQ ID NO: 367 - RNA, 25 nt, Homo sapiens
gguuuuauucugcagcuaccucccc

SEQ ID NO: 368 - RNA, 25 nt, Homo sapiens
auucugcagcuaccuccccaggaag

SEQ ID NO: 369 - RNA, 25 nt, Homo sapiens
cugcagcuaccuccccaggaagugg

SEQ ID NO: 370 - RNA, 25 nt, Homo sapiens
uaccuccccaggaaguggaggacug

SEQ ID NO: 371 - RNA, 25 nt, Homo sapiens
accuccccaggaaguggaggacugu

SEQ ID NO: 372 - RNA, 25 nt, Homo sapiens
ccuccccaggaaguggaggacugug

SEQ ID NO: 373 - RNA, 25 nt, Homo sapiens
ggccuuugagaaagcaccugccgac

SEQ ID NO: 374 - RNA, 25 nt, Homo sapiens
gccuuugagaaagcaccugccgaca

SEQ ID NO: 375 - RNA, 25 nt, Homo sapiens
cagguagggccgacgugucgacggc

SEQ ID NO: 376 - RNA, 25 nt, Homo sapiens
auuacagguagggccgacgugucga

SEQ ID NO: 377 - RNA, 25 nt, Homo sapiens
caggcacaguugccgauuacaggua

SEQ ID NO: 378 - RNA, 25 nt, Homo sapiens
gcaggcacaguugccgauuacaggu

SEQ ID NO: 379 - RNA, 25 nt, Homo sapiens
uccugcaggcacaguugccgauuac

SEQ ID NO: 380 - RNA, 25 nt, Homo sapiens
gcgcuuuucaccgcggccauccugc

SEQ ID NO: 381 - RNA, 25 nt, Homo sapiens
augaaguggaaggcgcuuuucaccg

SEQ ID NO: 382 - RNA, 25 nt, Homo sapiens
gagggaaaggacaagaugaagugga

SEQ ID NO: 383 - RNA, 25 nt, Homo sapiens
uucugagggaaaggacaagaugaag

SEQ ID NO: 384 - RNA, 25 nt, Homo sapiens
gccucccagccucuuucugagggaa

SEQ ID NO: 385 - RNA, 25 nt, Homo sapiens
ccucugccucccagccucuuucuga

SEQ ID NO: 386 - RNA, 25 nt, Homo sapiens
gccucugccucccagccucuuucug

SEQ ID NO: 387 - RNA, 25 nt, Homo sapiens
gagacuccuuuucuccuaaccgucc

SEQ ID NO: 388 - RNA, 25 nt, Homo sapiens
ccccacaguccuccacuuccugggg

SEQ ID NO: 389 - RNA, 25 nt, Homo sapiens
aggccccacaguccuccacuuccug

SEQ ID NO: 390 - RNA, 25 nt, Homo sapiens
aaggccccacaguccuccacuuccu

SEQ ID NO: 391 - RNA, 25 nt, Homo sapiens
aaaggccccacaguccuccacuucc

SEQ ID NO: 392 - RNA, 25 nt, Homo sapiens
gcccugucggcaggugcuuucucaa

SEQ ID NO: 393 - RNA, 25 nt, Homo sapiens
agcccaggcaccugcugagugaaag

SEQ ID NO: 394 - RNA, 25 nt, Homo sapiens
gcugagugaaagaggauauauuuau

SEQ ID NO: 395 - RNA, 25 nt, Homo sapiens
ggauauauuuauuggcugagcaaga

SEQ ID NO: 396 - RNA, 25 nt, Homo sapiens
gauauauuuauuggcugagcaagaa

SEQ ID NO: 397 - RNA, 25 nt, Homo sapiens
uauuuauuggcugagcaagaaggga

SEQ ID NO: 398 - RNA, 25 nt, Homo sapiens
gcugagcaagaagggaagguacagu

SEQ ID NO: 399 - RNA, 25 nt, Homo sapiens
caagaagggaagguacaguugguaa

SEQ ID NO: 400 - RNA, 25 nt, Homo sapiens
gcugcuucuagaagccaccagucuc

SEQ ID NO: 401 - RNA, 25 nt, Homo sapiens
cuuguuccgagcccaguuuccucca

SEQ ID NO: 402 - RNA, 25 nt, Homo sapiens
guuccgagcccaguuuccuccaagg

SEQ ID NO: 403 - RNA, 25 nt, Homo sapiens
gcuguacugagcaucaucucgaucu

SEQ ID NO: 404 - RNA, 25 nt, Homo sapiens
guacugagcaucaucucgaucucgg

SEQ ID NO: 405 - RNA, 25 nt, Homo sapiens
uacugagcaucaucucgaucucgga

SEQ ID NO: 406 - RNA, 25 nt, Homo sapiens
acugagcaucaucucgaucucggag

SEQ ID NO: 407 - RNA, 25 nt, Homo sapiens
aucucgaucucggaggggcuaagag

SEQ ID NO: 408 - RNA, 25 nt, Homo sapiens
ggggcuaagagaggagaagagaaaa

SEQ ID NO: 409 - RNA, 25 nt, Homo sapiens
acucagcaggugccugggcuucuua

SEQ ID NO: 410 - RNA, 25 nt, Homo sapiens
auccucuuucacucagcaggugccu

SEQ ID NO: 411 - RNA, 25 nt, Homo sapiens
uauccucuuucacucagcaggugcc

SEQ ID NO: 412 - RNA, 25 nt, Homo sapiens
auaaauauauccucuuucacucagc

SEQ ID NO: 413 - RNA, 25 nt, Homo sapiens
ucggaacaagugaaccugagacugg

SEQ ID NO: 414 - RNA, 25 nt, Homo sapiens
ggcucggaacaagugaaccugagac

SEQ ID NO: 415 - RNA, 25 nt, Homo sapiens
cagccaccuuggaggaaacugggcu

SEQ ID NO: 416 - RNA, 25 nt, Homo sapiens
caguacagccaccuuggaggaaacu

SEQ ID NO: 417 - RNA, 25 nt, Homo sapiens
ucaguacagccaccuuggaggaaac

SEQ ID NO: 418 - RNA, 25 nt, Homo sapiens
augaugcucaguacagccaccuugg

SEQ ID NO: 419 - RNA, 25 nt, Homo sapiens
gagaugaugcucaguacagccaccu

SEQ ID NO: 420 - RNA, 25 nt, Homo sapiens
ccccucaacgcucaccugauagacc

SEQ ID NO: 421 - RNA, 25 nt, Homo sapiens
ucauuccucaacagagcuugugugu

SEQ ID NO: 422 - RNA, 25 nt, Homo sapiens
uaucaggugagcguugaggggaagg

SEQ ID NO: 423 - RNA, 25 nt, Homo sapiens
gucuaucaggugagcguugagggga

SEQ ID NO: 424 - RNA, 25 nt, Homo sapiens
ccaggucuaucaggugagcguugag

SEQ ID NO: 425 - RNA, 25 nt, Homo sapiens
accaggucuaucaggugagcguuga

SEQ ID NO: 426 - RNA, 25 nt, Homo sapiens
gaccaggucuaucaggugagcguug

SEQ ID NO: 427 - RNA, 25 nt, Homo sapiens
cuguugaggaaugaccaggucuauc

SEQ ID NO: 428 - RNA, 25 nt, Homo sapiens
acacaagcucuguugaggaaugacc

SEQ ID NO: 429 - RNA, 25 nt, Homo sapiens
agcugccgacacacaagcucuguug

SEQ ID NO: 430 - RNA, 25 nt, Homo sapiens
agcaaagcagaagacucccaaagca

SEQ ID NO: 431 - RNA, 25 nt, Homo sapiens
aagacucccaaagcaaggagcagag

SEQ ID NO: 432 - RNA, 25 nt, Homo sapiens
acaucagugacaaugaugccagcca

SEQ ID NO: 433 - RNA, 25 nt, Homo sapiens
ucagugacaaugaugccagccacgg

SEQ ID NO: 434 - RNA, 25 nt, Homo sapiens
ugacaaugaugccagccacgguggc

SEQ ID NO: 435 - RNA, 25 nt, Homo sapiens
ggcuggauccagcuccacacagcuc

SEQ ID NO: 436 - RNA, 25 nt, Homo sapiens
agcuccacacagcucuggcacacug

SEQ ID NO: 437 - RNA, 25 nt, Homo sapiens
gcuccacacagcucuggcacacugu

SEQ ID NO: 438 - RNA, 25 nt, Homo sapiens
cuccacacagcucuggcacacugug

SEQ ID NO: 439 - RNA, 25 nt, Homo sapiens
uccacacagcucuggcacacugugg

SEQ ID NO: 440 - RNA, 25 nt, Homo sapiens
cacagcucuggcacacuguggggga

SEQ ID NO: 441 - RNA, 25 nt, Homo sapiens
acagcucuggcacacugugggggaa

SEQ ID NO: 442 - RNA, 25 nt, Homo sapiens
gcucuggcacacugugggggaaggg

SEQ ID NO: 443 - RNA, 25 nt, Homo sapiens
cacacugugggggaagggaggagag

SEQ ID NO: 444 - RNA, 25 nt, Homo sapiens
gacuggaaggcugucuggggguuag

SEQ ID NO: 445 - RNA, 25 nt, Homo sapiens
gacaugagacuggaaggcugucugg

SEQ ID NO: 446 - RNA, 25 nt, Homo sapiens
ggacaugagacuggaaggcugucug

SEQ ID NO: 447 - RNA, 25 nt, Homo sapiens
uggacaugagacuggaaggcugucu

SEQ ID NO: 448 - RNA, 25 nt, Homo sapiens
cuggacaugagacuggaaggcuguc

SEQ ID NO: 449 - RNA, 25 nt, Homo sapiens
cugcuuugcuggacaugagacugga

SEQ ID NO: 450 - RNA, 25 nt, Homo sapiens
ucuucugcuuugcuggacaugagac

SEQ ID NO: 451 - RNA, 25 nt, Homo sapiens
uugcuuugggagucuucugcuuugc

SEQ ID NO: 452 - RNA, 25 nt, Homo sapiens
ucauugccacucugcuccuugcuuu

SEQ ID NO: 453 - RNA, 25 nt, Homo sapiens
gucauugccacucugcuccuugcuu

SEQ ID NO: 454 - RNA, 25 nt, Homo sapiens
uggagcuggauccagccaccguggc

SEQ ID NO: 455 - RNA, 25 nt, Homo sapiens
uguguggagcuggauccagccaccg

SEQ ID NO: 456 - RNA, 25 nt, Homo sapiens
acagugugccagagcuguguggagc

SEQ ID NO: 457 - RNA, 25 nt, Homo sapiens
ucccccacagugugccagagcugug

SEQ ID NO: 458 - RNA, 25 nt, Homo sapiens
cacguacuucgauaaugaacuugca

SEQ ID NO: 459 - RNA, 25 nt, Homo sapiens
ucccauuacaccuauauauuccucg

SEQ ID NO: 460 - RNA, 25 nt, Homo sapiens
cccauuacaccuauauauuccucgu

SEQ ID NO: 461 - RNA, 25 nt, Homo sapiens
acaccuauauauuccucgugggucc

SEQ ID NO: 462 - RNA, 25 nt, Homo sapiens
ucguggguccaggaugcguuuuccc

SEQ ID NO: 463 - RNA, 25 nt, Homo sapiens
accguucccucuacccaugugaugc

SEQ ID NO: 464 - RNA, 25 nt, Homo sapiens
acacucuguccucaaguuccucuau

SEQ ID NO: 465 - RNA, 25 nt, Homo sapiens
ucaaguuccucuauagguaucuuga

SEQ ID NO: 466 - RNA, 25 nt, Homo sapiens
caaguuccucuauagguaucuugaa

SEQ ID NO: 467 - RNA, 25 nt, Homo sapiens
aaguuccucuauagguaucuugaag

SEQ ID NO: 468 - RNA, 25 nt, Homo sapiens
uagguaucuugaaggggcucacuaa

SEQ ID NO: 469 - RNA, 25 nt, Homo sapiens
agguaucuugaaggggcucacuaaa

SEQ ID NO: 470 - RNA, 25 nt, Homo sapiens
gguaucuugaaggggcucacuaaag

SEQ ID NO: 471 - RNA, 25 nt, Homo sapiens
gaaguacgugcuuccugaacccuuu

SEQ ID NO: 472 - RNA, 25 nt, Homo sapiens
cgaaguacgugcuuccugaacccuu

SEQ ID NO: 473 - RNA, 25 nt, Homo sapiens
agguguaaugggacagauauauaca

SEQ ID NO: 474 - RNA, 25 nt, Homo sapiens
cccacgaggaauauauagguguaau

SEQ ID NO: 475 - RNA, 25 nt, Homo sapiens
acccacgaggaauauauagguguaa

SEQ ID NO: 476 - RNA, 25 nt, Homo sapiens
cauccuggacccacgaggaauauau

SEQ ID NO: 477 - RNA, 25 nt, Homo sapiens
ugggaaaacgcauccuggacccacg

SEQ ID NO: 478 - RNA, 25 nt, Homo sapiens
agacuggaccugggaaaacgcaucc

SEQ ID NO: 479 - RNA, 25 nt, Homo sapiens
ucucagacauuacaagacuggaccu

SEQ ID NO: 480 - RNA, 25 nt, Homo sapiens
cucucagacauuacaagacuggacc

SEQ ID NO: 481 - RNA, 25 nt, Homo sapiens
acacugcucucagacauuacaagac

SEQ ID NO: 482 - RNA, 25 nt, Homo sapiens
gcaucacauggguagagggaacggu

SEQ ID NO: 483 - RNA, 25 nt, Homo sapiens
agcaucacauggguagagggaacgg

SEQ ID NO: 484 - RNA, 25 nt, Homo sapiens
accagcaucacauggguagagggaa

SEQ ID NO: 485 - RNA, 25 nt, Homo sapiens
gcaauaccagcaucacauggguaga

SEQ ID NO: 486 - RNA, 25 nt, Homo sapiens
ugcaauaccagcaucacauggguag

SEQ ID NO: 487 - RNA, 25 nt, Homo sapiens
gugaauugcaauaccagcaucacau

SEQ ID NO: 488 - RNA, 25 nt, Homo sapiens
ugugaauugcaauaccagcaucaca

SEQ ID NO: 489 - RNA, 25 nt, Homo sapiens
uucaagauaccuauagaggaacuug

SEQ ID NO: 490 - RNA, 25 nt, Homo sapiens
gugagccccuucaagauaccuauag

SEQ ID NO: 491 - RNA, 25 nt, Homo sapiens
uggaguagccuuaccuugcgagaga

SEQ ID NO: 492 - RNA, 25 nt, Homo sapiens
ggaguagccuuaccuugcgagagaa

SEQ ID NO: 493 - RNA, 25 nt, Homo sapiens
uugcgagagaaggguagccaguacc

SEQ ID NO: 494 - RNA, 25 nt, Homo sapiens
aaacgugcuauguuccaucucccag

SEQ ID NO: 495 - RNA, 25 nt, Homo sapiens
cggaacucauccaguagauaaagcc

SEQ ID NO: 496 - RNA, 25 nt, Homo sapiens
aagccaggucaccgaacuaucagcc

SEQ ID NO: 497 - RNA, 25 nt, Homo sapiens
agccaggucaccgaacuaucagccu

SEQ ID NO: 498 - RNA, 25 nt, Homo sapiens
agcugcccuccccuagcugacucac

SEQ ID NO: 499 - RNA, 25 nt, Homo sapiens
ccuccccuagcugacucacagguac

SEQ ID NO: 500 - RNA, 25 nt, Homo sapiens
uagcugacucacagguaccggaaag

SEQ ID NO: 501 - RNA, 25 nt, Homo sapiens
cucacagguaccggaaagaggagag

SEQ ID NO: 502 - RNA, 25 nt, Homo sapiens
ucacagguaccggaaagaggagagu

SEQ ID NO: 503 - RNA, 25 nt, Homo sapiens
cacagguaccggaaagaggagagug

SEQ ID NO: 504 - RNA, 25 nt, Homo sapiens
acagguaccggaaagaggagagugg

SEQ ID NO: 505 - RNA, 25 nt, Homo sapiens
gguaccggaaagaggagaguggggg

SEQ ID NO: 506 - RNA, 25 nt, Homo sapiens
cugcuucucugcuuucugccguuga

SEQ ID NO: 507 - RNA, 25 nt, Homo sapiens
cuucucugcuuucugccguugaugg

SEQ ID NO: 508 - RNA, 25 nt, Homo sapiens
uucucugcuuucugccguugauggu

SEQ ID NO: 509 - RNA, 25 nt, Homo sapiens
aagguaaggcuacuccaggugggug

SEQ ID NO: 510 - RNA, 25 nt, Homo sapiens
caagguaaggcuacuccaggugggu

SEQ ID NO: 511 - RNA, 25 nt, Homo sapiens
gcaagguaaggcuacuccagguggg

SEQ ID NO: 512 - RNA, 25 nt, Homo sapiens
cucgcaagguaaggcuacuccaggu

SEQ ID NO: 513 - RNA, 25 nt, Homo sapiens
ucucgcaagguaaggcuacuccagg

SEQ ID NO: 514 - RNA, 25 nt, Homo sapiens
uucucucgcaagguaaggcuacucc

SEQ ID NO: 515 - RNA, 25 nt, Homo sapiens
cuggcuacccuucucucgcaaggua

SEQ ID NO: 516 - RNA, 25 nt, Homo sapiens
ugguacuggcuacccuucucucgca

SEQ ID NO: 517 - RNA, 25 nt, Homo sapiens
agcacguuucucucuggccugguac

SEQ ID NO: 518 - RNA, 25 nt, Homo sapiens
gaacauagcacguuucucucuggcc

SEQ ID NO: 519 - RNA, 25 nt, Homo sapiens
agauggaacauagcacguuucucuc

SEQ ID NO: 520 - RNA, 25 nt, Homo sapiens
cuacuggaugaguuccgcugggaga

SEQ ID NO: 521 - RNA, 25 nt, Homo sapiens
cuuuaucuacuggaugaguuccgcu

SEQ ID NO: 522 - RNA, 25 nt, Homo sapiens
gcuuuaucuacuggaugaguuccgc

SEQ ID NO: 523 - RNA, 25 nt, Homo sapiens
aguucggugaccuggcuuuaucuac

SEQ ID NO: 524 - RNA, 25 nt, Homo sapiens
cacccaggcugauaguucggugacc

SEQ ID NO: 525 - RNA, 25 nt, Homo sapiens
gcagcucucacccaggcugauaguu

SEQ ID NO: 526 - RNA, 25 nt, Homo sapiens
agcuaggggagggcagcucucaccc

SEQ ID NO: 527 - RNA, 25 nt, Homo sapiens
cgguaccugugagucagcuagggga

SEQ ID NO: 528 - RNA, 25 nt, Homo sapiens
ccgguaccugugagucagcuagggg

SEQ ID NO: 529 - RNA, 25 nt, Homo sapiens
uuuccgguaccugugagucagcuag

SEQ ID NO: 530 - RNA, 25 nt, Homo sapiens
cuuuccgguaccugugagucagcua

SEQ ID NO: 531 - RNA, 25 nt, Homo sapiens
ucuuuccgguaccugugagucagcu

SEQ ID NO: 532 - RNA, 25 nt, Homo sapiens
aguuccucccccacucuccucuuuc

SEQ ID NO: 533 - RNA, 25 nt, Homo sapiens
cagguauugucagaguccucuuguu

SEQ ID NO: 534 - RNA, 25 nt, Homo sapiens
ucagaguccucuuguuuggccuucu

SEQ ID NO: 535 - RNA, 25 nt, Homo sapiens
aguccucuuguuuggccuucuagga

SEQ ID NO: 536 - RNA, 25 nt, Homo sapiens
cuuguuuggccuucuaggaaggcug

SEQ ID NO: 537 - RNA, 25 nt, Homo sapiens
uuguuuggccuucuaggaaggcugu

SEQ ID NO: 538 - RNA, 25 nt, Homo sapiens
ggacccagcuuucuucaaccagucc

SEQ ID NO: 539 - RNA, 25 nt, Homo sapiens
cccagcuuucuucaaccaguccagg

SEQ ID NO: 540 - RNA, 25 nt, Homo sapiens
agcuuucuucaaccaguccaggugg

SEQ ID NO: 541 - RNA, 25 nt, Homo sapiens
ccucugccuugaacguuuccaagug

SEQ ID NO: 542 - RNA, 25 nt, Homo sapiens
cguuuccaagugagguaaaacccgc

SEQ ID NO: 543 - RNA, 25 nt, Homo sapiens
agugagguaaaacccgcaggcccag

SEQ ID NO: 544 - RNA, 25 nt, Homo sapiens
cccagaggccucucuacuuccugug

SEQ ID NO: 545 - RNA, 25 nt, Homo sapiens
ccagaggccucucuacuuccugugu

SEQ ID NO: 546 - RNA, 25 nt, Homo sapiens
cagaggccucucuacuuccugugug

SEQ ID NO: 547 - RNA, 25 nt, Homo sapiens
gaaacccuccuccccucccagccuc

SEQ ID NO: 548 - RNA, 25 nt, Homo sapiens
agccucaggugccugcuucagaaaa

SEQ ID NO: 549 - RNA, 25 nt, Homo sapiens
aagaggacucugacaauaccuggag

SEQ ID NO: 550 - RNA, 25 nt, Homo sapiens
caagaggacucugacaauaccugga

SEQ ID NO: 551 - RNA, 25 nt, Homo sapiens
acaagaggacucugacaauaccugg

SEQ ID NO: 552 - RNA, 25 nt, Homo sapiens
caaacaagaggacucugacaauacc

SEQ ID NO: 553 - RNA, 25 nt, Homo sapiens
cagccuuccuagaaggccaaacaag

SEQ ID NO: 554 - RNA, 25 nt, Homo sapiens
agcugggucccacagccuuccuaga

SEQ ID NO: 555 - RNA, 25 nt, Homo sapiens
ccaccuggacugguugaagaaagcu

SEQ ID NO: 556 - RNA, 25 nt, Homo sapiens
uccaccuggacugguugaagaaagc

SEQ ID NO: 557 - RNA, 25 nt, Homo sapiens
ucaaggcagaggccuccaccuggac

SEQ ID NO: 558 - RNA, 25 nt, Homo sapiens
aacguucaaggcagaggccuccacc

SEQ ID NO: 559 - RNA, 25 nt, Homo sapiens
ccucacuuggaaacguucaaggcag

SEQ ID NO: 560 - RNA, 25 nt, Homo sapiens
guuuuaccucacuuggaaacguuca

SEQ ID NO: 561 - RNA, 25 nt, Homo sapiens
cugggccugcggguuuuaccucacu

SEQ ID NO: 562 - RNA, 25 nt, Homo sapiens
gaaguagagaggccucugggccugc

SEQ ID NO: 563 - RNA, 25 nt, Homo sapiens
ggaaguagagaggccucugggccug

SEQ ID NO: 564 - RNA, 25 nt, Homo sapiens
ccacacaggaaguagagaggccucu

SEQ ID NO: 565 - RNA, 25 nt, Homo sapiens
cccacacaggaaguagagaggccuc

SEQ ID NO: 566 - RNA, 25 nt, Homo sapiens
ucugaaccccacacaggaaguagag

SEQ ID NO: 567 - RNA, 25 nt, Homo sapiens
ggaggaggguuucugaaccccacac

SEQ ID NO: 568 - RNA, 25 nt, Homo sapiens
ggcaccugaggcugggaggggagga

SEQ ID NO: 569 - RNA, 25 nt, Homo sapiens
aggcaccugaggcugggaggggagg

SEQ ID NO: 570 - RNA, 25 nt, Homo sapiens
agcaggcaccugaggcugggagggg

SEQ ID NO: 571 - RNA, 25 nt, Homo sapiens
ugaagcaggcaccugaggcugggag

SEQ ID NO: 572 - RNA, 25 nt, Homo sapiens
cugaagcaggcaccugaggcuggga

SEQ ID NO: 573 - RNA, 25 nt, Homo sapiens
ucugaagcaggcaccugaggcuggg

SEQ ID NO: 574 - RNA, 25 nt, Homo sapiens
uuuucugaagcaggcaccugaggcu

SEQ ID NO: 575 - RNA, 25 nt, Homo sapiens
auuuucugaagcaggcaccugaggc

SEQ ID NO: 576 - RNA, 25 nt, Homo sapiens
caccauuuucugaagcaggcaccug

SEQ ID NO: 577 - RNA, 25 nt, Homo sapiens
agagagacucaccauuuucugaagc

SEQ ID NO: 578 - RNA, 25 nt, Homo sapiens
uuuuuuccagaaguaguaagucugc

SEQ ID NO: 579 - RNA, 25 nt, Homo sapiens
cagucccaugaaacaaagaugcagu

SEQ ID NO: 580 - RNA, 25 nt, Homo sapiens
agucccaugaaacaaagaugcaguc

SEQ ID NO: 581 - RNA, 25 nt, Homo sapiens
aacaaagaugcagucgggcacucac

SEQ ID NO: 582 - RNA, 25 nt, Homo sapiens
cagucgggcacucacuggagaguuc

SEQ ID NO: 583 - RNA, 25 nt, Homo sapiens
agucgggcacucacuggagaguucu

SEQ ID NO: 584 - RNA, 25 nt, Homo sapiens
gaguucugggccucugccucuuauc

SEQ ID NO: 585 - RNA, 25 nt, Homo sapiens
ggccucugccucuuaucaggugagu

SEQ ID NO: 586 - RNA, 25 nt, Homo sapiens
ucugccucuuaucaggugaguagga

SEQ ID NO: 587 - RNA, 25 nt, Homo sapiens
cucuuaucaggugaguaggauggag

SEQ ID NO: 588 - RNA, 25 nt, Homo sapiens
aucaggugaguaggauggaguggaa

SEQ ID NO: 589 - RNA, 25 nt, Homo sapiens
ucaggugaguaggauggaguggaaa

SEQ ID NO: 590 - RNA, 25 nt, Homo sapiens
cggaggccagcagacuuacuacuuc

SEQ ID NO: 591 - RNA, 25 nt, Homo sapiens
gacuguuacuuuacuaagauggcgg

SEQ ID NO: 592 - RNA, 25 nt, Homo sapiens
ugggacuguuacuuuacuaagaugg

SEQ ID NO: 593 - RNA, 25 nt, Homo sapiens
ucaugggacuguuacuuuacuaaga

SEQ ID NO: 594 - RNA, 25 nt, Homo sapiens
gugcccgacugcaucuuuguuucau

SEQ ID NO: 595 - RNA, 25 nt, Homo sapiens
agugcccgacugcaucuuuguuuca

SEQ ID NO: 596 - RNA, 25 nt, Homo sapiens
auccuacucaccugauaagaggcag

SEQ ID NO: 597 - RNA, 25 nt, Homo sapiens
cacuccauccuacucaccugauaag

SEQ ID NO: 598 - RNA, 25 nt, Homo sapiens
uuuuuuuucuuauuuauuuucuagu

SEQ ID NO: 599 - RNA, 25 nt, Homo sapiens
ucuuauuuauuuucuaguuggcguu

SEQ ID NO: 600 - RNA, 25 nt, Homo sapiens
cuuauuuauuuucuaguuggcguuu

SEQ ID NO: 601 - RNA, 25 nt, Homo sapiens
uuauuuauuuucuaguuggcguuug

SEQ ID NO: 602 - RNA, 25 nt, Homo sapiens
uauuuauuuucuaguuggcguuugg

SEQ ID NO: 603 - RNA, 25 nt, Homo sapiens
uucuaguuggcguuugggggcaaga

SEQ ID NO: 604 - RNA, 25 nt, Homo sapiens
guuuccuuuucagguaaugaagaaa

SEQ ID NO: 605 - RNA, 25 nt, Homo sapiens
uuuccuuuucagguaaugaagaaau

SEQ ID NO: 606 - RNA, 25 nt, Homo sapiens
uuacccauuucuucauuaccugaaa

SEQ ID NO: 607 - RNA, 25 nt, Homo sapiens
gcuguuuccuuuuuucauuuucagg

SEQ ID NO: 608 - RNA, 25 nt, Homo sapiens
guauuacacagacacgugaguuuau

SEQ ID NO: 609 - RNA, 25 nt, Homo sapiens
uguaauaccaccugaaaaugaaaaa

SEQ ID NO: 610 - RNA, 25 nt, Homo sapiens
ccccagcauauaaagucuccaucuc

SEQ ID NO: 611 - RNA, 25 nt, Homo sapiens
uaauauugacaugcccucaguaucc

SEQ ID NO: 612 - RNA, 25 nt, Homo sapiens
ucaguauccuggaucugaaauacua

SEQ ID NO: 613 - RNA, 25 nt, Homo sapiens
uauggcaacacaaugauaaaaacau

SEQ ID NO: 614 - RNA, 25 nt, Homo sapiens
ggcaacacaaugauaaaaacauagg

SEQ ID NO: 615 - RNA, 25 nt, Homo sapiens
aaugauaaaaacauaggcggugaug

SEQ ID NO: 616 - RNA, 25 nt, Homo sapiens
gcggugaugaggaugauaaaaacau

SEQ ID NO: 617 - RNA, 25 nt, Homo sapiens
gaugauaaaaacauaggcagugaug

SEQ ID NO: 618 - RNA, 25 nt, Homo sapiens
agugaugaggaucaccugucacuga

SEQ ID NO: 619 - RNA, 25 nt, Homo sapiens
cugucacugaaggaauuuucagaau

SEQ ID NO: 620 - RNA, 25 nt, Homo sapiens
aggaauuuucagaauuggagcaaag

SEQ ID NO: 621 - RNA, 25 nt, Homo sapiens
gugguuauuaugucugcuaccccag

SEQ ID NO: 622 - RNA, 25 nt, Homo sapiens
agaugcgaacuuuuaucucuaccug

SEQ ID NO: 623 - RNA, 25 nt, Homo sapiens
gaugcgaacuuuuaucucuaccuga

SEQ ID NO: 624 - RNA, 25 nt, Homo sapiens
acuuuuaucucuaccugagggcaag

SEQ ID NO: 625 - RNA, 25 nt, Homo sapiens
ucuaccugagggcaagagguaaucc

SEQ ID NO: 626 - RNA, 25 nt, Homo sapiens
aagagguaauccaggucuccagaac

SEQ ID NO: 627 - RNA, 25 nt, Homo sapiens
uaugcuggggagaaagaagggaaau

SEQ ID NO: 628 - RNA, 25 nt, Homo sapiens
gacuuuauaugcuggggagaaagaa

SEQ ID NO: 629 - RNA, 25 nt, Homo sapiens
agacuuuauaugcuggggagaaaga

SEQ ID NO: 630 - RNA, 25 nt, Homo sapiens
ccagagauggagacuuuauaugcug

SEQ ID NO: 631 - RNA, 25 nt, Homo sapiens
uccagagauggagacuuuauaugcu

SEQ ID NO: 632 - RNA, 25 nt, Homo sapiens
uuccagagauggagacuuuauaugc

SEQ ID NO: 633 - RNA, 25 nt, Homo sapiens
gucaauauuacugugguuccagaga

SEQ ID NO: 634 - RNA, 25 nt, Homo sapiens
uacugagggcaugucaauauuacug

SEQ ID NO: 635 - RNA, 25 nt, Homo sapiens
uaguauuucagauccaggauacuga

SEQ ID NO: 636 - RNA, 25 nt, Homo sapiens
auaguauuucagauccaggauacug

SEQ ID NO: 637 - RNA, 25 nt, Homo sapiens
uguguugccauaguauuucagaucc

SEQ ID NO: 638 - RNA, 25 nt, Homo sapiens
caauucugaaaauuccuucagugac

SEQ ID NO: 639 - RNA, 25 nt, Homo sapiens
cgcaucuucugguuugcuuccucug

SEQ ID NO: 640 - RNA, 25 nt, Homo sapiens
ucgcaucuucugguuugcuuccucu

SEQ ID NO: 641 - RNA, 25 nt, Homo sapiens
uucgcaucuucugguuugcuuccuc

SEQ ID NO: 642 - RNA, 25 nt, Homo sapiens
gguagagauaaaaguucgcaucuuc

SEQ ID NO: 643 - RNA, 25 nt, Homo sapiens
gagaccuggauuaccucuugcccuc

SEQ ID NO: 644 - RNA, 25 nt, Homo sapiens
ccccccacagugugugagaacugca

SEQ ID NO: 645 - RNA, 25 nt, Homo sapiens
acagugugugagaacugcauggaga

SEQ ID NO: 646 - RNA, 25 nt, Homo sapiens
aacugcauggagauggaugugaugu

SEQ ID NO: 647 - RNA, 25 nt, Homo sapiens
ugcauggagauggaugugaugucgg

SEQ ID NO: 648 - RNA, 25 nt, Homo sapiens
augucgguggccacaauugucauag

SEQ ID NO: 649 - RNA, 25 nt, Homo sapiens
uugucauaguggacaucugcaucac

SEQ ID NO: 650 - RNA, 25 nt, Homo sapiens
ugucauaguggacaucugcaucacu

SEQ ID NO: 651 - RNA, 25 nt, Homo sapiens
gucauaguggacaucugcaucacug

SEQ ID NO: 652 - RNA, 25 nt, Homo sapiens
ucauaguggacaucugcaucacugg

SEQ ID NO: 653 - RNA, 25 nt, Homo sapiens
ugcaucacugggggcuugcugcugc

SEQ ID NO: 654 - RNA, 25 nt, Homo sapiens
gggcuugcugcugcugguuuacuac

SEQ ID NO: 655 - RNA, 25 nt, Homo sapiens
guuuacuacuggagcaagaauagaa

SEQ ID NO: 656 - RNA, 25 nt, Homo sapiens
uacuggagcaagaauagaaaggcca

SEQ ID NO: 657 - RNA, 25 nt, Homo sapiens
aggccaaggccaagccugugacacg

SEQ ID NO: 658 - RNA, 25 nt, Homo sapiens
aaggccaagccugugacacgaggag

SEQ ID NO: 659 - RNA, 25 nt, Homo sapiens
aggccaagccugugacacgaggagc

SEQ ID NO: 660 - RNA, 25 nt, Homo sapiens
agccugugacacgaggagcgggugc

SEQ ID NO: 661 - RNA, 25 nt, Homo sapiens
cugugacacgaggagcgggugcugg

SEQ ID NO: 662 - RNA, 25 nt, Homo sapiens
gacacgaggagcgggugcuggcggc

SEQ ID NO: 663 - RNA, 25 nt, Homo sapiens
aggagcgggugcuggcggcaggcaa

SEQ ID NO: 664 - RNA, 25 nt, Homo sapiens
ggagcgggugcuggcggcaggcaaa

SEQ ID NO: 665 - RNA, 25 nt, Homo sapiens
gagcgggugcuggcggcaggcaaag

SEQ ID NO: 666 - RNA, 25 nt, Homo sapiens
ggugcuggcggcaggcaaaggggua

SEQ ID NO: 667 - RNA, 25 nt, Homo sapiens
ggcggcaggcaaagggguaaggcug

SEQ ID NO: 668 - RNA, 25 nt, Homo sapiens
acacuguggggggugggguggggag

SEQ ID NO: 669 - RNA, 25 nt, Homo sapiens
cucacacacugugggggguggggug

SEQ ID NO: 670 - RNA, 25 nt, Homo sapiens
ucucacacacugugggggguggggu

SEQ ID NO: 671 - RNA, 25 nt, Homo sapiens
uucucacacacuguggggggugggg

SEQ ID NO: 672 - RNA, 25 nt, Homo sapiens
caguucucacacacuguggggggug

SEQ ID NO: 673 - RNA, 25 nt, Homo sapiens
gcaguucucacacacuguggggggu

SEQ ID NO: 674 - RNA, 25 nt, Homo sapiens
ugcaguucucacacacugugggggg

SEQ ID NO: 675 - RNA, 25 nt, Homo sapiens
ccaugcaguucucacacacuguggg

SEQ ID NO: 676 - RNA, 25 nt, Homo sapiens
uccaugcaguucucacacacugugg

SEQ ID NO: 677 - RNA, 25 nt, Homo sapiens
cuccaugcaguucucacacacugug

SEQ ID NO: 678 - RNA, 25 nt, Homo sapiens
ucuccaugcaguucucacacacugu

SEQ ID NO: 679 - RNA, 25 nt, Homo sapiens
aucuccaugcaguucucacacacug

SEQ ID NO: 680 - RNA, 25 nt, Homo sapiens
augcagauguccacuaugacaauug

SEQ ID NO: 681 - RNA, 25 nt, Homo sapiens
gcuccucgugucacaggcuuggccu

SEQ ID NO: 682 - RNA, 25 nt, Homo sapiens
gcacccgcuccucgugucacaggcu

SEQ ID NO: 683 - RNA, 25 nt, Homo sapiens
cgccagcacccgcuccucgugucac

SEQ ID NO: 684 - RNA, 25 nt, Homo sapiens
ccuccuuccuccgcaggacaaaaca

SEQ ID NO: 685 - RNA, 25 nt, Homo sapiens
uuccuccgcaggacaaaacaaggag

SEQ ID NO: 686 - RNA, 25 nt, Homo sapiens
ccaccuguucccaacccagacuaug

SEQ ID NO: 687 - RNA, 25 nt, Homo sapiens
ucccaacccagacuaugagguaacg

SEQ ID NO: 688 - RNA, 25 nt, Homo sapiens
cccaacccagacuaugagguaacgu

SEQ ID NO: 689 - RNA, 25 nt, Homo sapiens
acuaugagguaacgugggauagaaa

SEQ ID NO: 690 - RNA, 25 nt, Homo sapiens
cuaugagguaacgugggauagaaau

SEQ ID NO: 691 - RNA, 25 nt, Homo sapiens
uuguuuuguccugcggaggaaggag

SEQ ID NO: 692 - RNA, 25 nt, Homo sapiens
cuuguuuuguccugcggaggaagga

SEQ ID NO: 693 - RNA, 25 nt, Homo sapiens
ccuuguuuuguccugcggaggaagg

SEQ ID NO: 694 - RNA, 25 nt, Homo sapiens
ucuccuuguuuuguccugcggagga

SEQ ID NO: 695 - RNA, 25 nt, Homo sapiens
ggccucuccuuguuuuguccugcgg

SEQ ID NO: 696 - RNA, 25 nt, Homo sapiens
gguggccucuccuuguuuuguccug

SEQ ID NO: 697 - RNA, 25 nt, Homo sapiens
cauagucuggguugggaacaggugg

SEQ ID NO: 698 - RNA, 25 nt, Homo sapiens
ccucauagucuggguugggaacagg

SEQ ID NO: 699 - RNA, 25 nt, Homo sapiens
uuaccucauagucuggguugggaac

SEQ ID NO: 700 - RNA, 25 nt, Homo sapiens
cccacguuaccucauagucuggguu

SEQ ID NO: 701 - RNA, 25 nt, Homo sapiens
ucccacguuaccucauagucugggu

SEQ ID NO: 702 - RNA, 25 nt, Homo sapiens
ucuaucccacguuaccucauagucu

SEQ ID NO: 703 - RNA, 25 nt, Homo sapiens
uucuaucccacguuaccucauaguc

SEQ ID NO: 704 - RNA, 25 nt, Homo sapiens
cucucuauuucacccccagcccauc

SEQ ID NO: 705 - RNA, 25 nt, Homo sapiens
uauuucacccccagcccauccggaa

SEQ ID NO: 706 - RNA, 25 nt, Homo sapiens
cccccagcccauccggaaaggccag

SEQ ID NO: 707 - RNA, 25 nt, Homo sapiens
ccccagcccauccggaaaggccagc

SEQ ID NO: 708 - RNA, 25 nt, Homo sapiens
ggaaaggccagcgggaccuguauuc

SEQ ID NO: 709 - RNA, 25 nt, Homo sapiens
ugaaucagagacgcaucugacccuc

SEQ ID NO: 710 - RNA, 25 nt, Homo sapiens
cccucuggagaacacugccucccgc

SEQ ID NO: 711 - RNA, 25 nt, Homo sapiens
ggagaacacugccucccgcuggccc

SEQ ID NO: 712 - RNA, 25 nt, Homo sapiens
agucccccugcgacucccuguuucc

SEQ ID NO: 713 - RNA, 25 nt, Homo sapiens
gucccccugcgacucccuguuuccu

SEQ ID NO: 714 - RNA, 25 nt, Homo sapiens
gacucccuguuuccugggcuagucu

SEQ ID NO: 715 - RNA, 25 nt, Homo sapiens
gagagagaaucguuccucagccuca

SEQ ID NO: 716 - RNA, 25 nt, Homo sapiens
gcucccuccucccugccuucucugc

SEQ ID NO: 717 - RNA, 25 nt, Homo sapiens
ucaucaguagucacacccucacagc

SEQ ID NO: 718 - RNA, 25 nt, Homo sapiens
cucacagcuggccugcccucuugcc

SEQ ID NO: 719 - RNA, 25 nt, Homo sapiens
uuugugcuauucacucccuucccuu

SEQ ID NO: 720 - RNA, 25 nt, Homo sapiens
cgccguccccuuuugcagcccucuc

SEQ ID NO: 721 - RNA, 25 nt, Homo sapiens
gccguccccuuuugcagcccucucu

SEQ ID NO: 722 - RNA, 25 nt, Homo sapiens
ccguccccuuuugcagcccucucug

SEQ ID NO: 723 - RNA, 25 nt, Homo sapiens
ccccuuuugcagcccucucugggga

SEQ ID NO: 724 - RNA, 25 nt, Homo sapiens
uuugcagcccucucuggggauggac

SEQ ID NO: 725 - RNA, 25 nt, Homo sapiens
uugcagcccucucuggggauggacu

SEQ ID NO: 726 - RNA, 25 nt, Homo sapiens
ggauggacuggguaaauguugacag

SEQ ID NO: 727 - RNA, 25 nt, Homo sapiens
gaggcccugccccguucacagaucc

SEQ ID NO: 728 - RNA, 25 nt, Homo sapiens
acucccuccacccccccuccacugu

SEQ ID NO: 729 - RNA, 25 nt, Homo sapiens
ccacccccccuccacuguaggccac

SEQ ID NO: 730 - RNA, 25 nt, Homo sapiens
ccccccuccacuguaggccacugga

SEQ ID NO: 731 - RNA, 25 nt, Homo sapiens
gagagagaaaaaaauaaacuguauu

SEQ ID NO: 732 - RNA, 25 nt, Homo sapiens
augggcugggggugaaauagagagg

SEQ ID NO: 733 - RNA, 25 nt, Homo sapiens
gaugggcugggggugaaauagagag

SEQ ID NO: 734 - RNA, 25 nt, Homo sapiens
ggaugggcugggggugaaauagaga

SEQ ID NO: 735 - RNA, 25 nt, Homo sapiens
cggaugggcugggggugaaauagag

SEQ ID NO: 736 - RNA, 25 nt, Homo sapiens
ccgcuggccuuuccggaugggcugg

SEQ ID NO: 737 - RNA, 25 nt, Homo sapiens
cccgcuggccuuuccggaugggcug

SEQ ID NO: 738 - RNA, 25 nt, Homo sapiens
ucccgcuggccuuuccggaugggcu

SEQ ID NO: 739 - RNA, 25 nt, Homo sapiens
gucccgcuggccuuuccggaugggc

SEQ ID NO: 740 - RNA, 25 nt, Homo sapiens
acaggucccgcuggccuuuccggau

SEQ ID NO: 741 - RNA, 25 nt, Homo sapiens
uacaggucccgcuggccuuuccgga

SEQ ID NO: 742 - RNA, 25 nt, Homo sapiens
agaauacaggucccgcuggccuuuc

SEQ ID NO: 743 - RNA, 25 nt, Homo sapiens
auucaggccagaauacaggucccgc

SEQ ID NO: 744 - RNA, 25 nt, Homo sapiens
gcgucucugauucaggccagaauac

SEQ ID NO: 745 - RNA, 25 nt, Homo sapiens
agagggucagaugcgucucugauuc

SEQ ID NO: 746 - RNA, 25 nt, Homo sapiens
ccagcgggaggcaguguucuccaga

SEQ ID NO: 747 - RNA, 25 nt, Homo sapiens
gccagcgggaggcaguguucuccag

SEQ ID NO: 748 - RNA, 25 nt, Homo sapiens
uggagaggagaccugggccagcggg

SEQ ID NO: 749 - RNA, 25 nt, Homo sapiens
gacuggagaggagaccugggccagc

SEQ ID NO: 750 - RNA, 25 nt, Homo sapiens
ggacuggagaggagaccugggccag

SEQ ID NO: 751 - RNA, 25 nt, Homo sapiens
cgcagggggacuggagaggagaccu

SEQ ID NO: 752 - RNA, 25 nt, Homo sapiens
ucgcagggggacuggagaggagacc

SEQ ID NO: 753 - RNA, 25 nt, Homo sapiens
acagggagucgcagggggacuggag

SEQ ID NO: 754 - RNA, 25 nt, Homo sapiens
aggaaacagggagucgcagggggac

SEQ ID NO: 755 - RNA, 25 nt, Homo sapiens
agcccaggaaacagggagucgcagg

SEQ ID NO: 756 - RNA, 25 nt, Homo sapiens
uagcccaggaaacagggagucgcag

SEQ ID NO: 757 - RNA, 25 nt, Homo sapiens
cuagcccaggaaacagggagucgca

SEQ ID NO: 758 - RNA, 25 nt, Homo sapiens
acuagcccaggaaacagggagucgc

SEQ ID NO: 759 - RNA, 25 nt, Homo sapiens
ggguccaagacuagcccaggaaaca

SEQ ID NO: 760 - RNA, 25 nt, Homo sapiens
gggguccaagacuagcccaggaaac

SEQ ID NO: 761 - RNA, 25 nt, Homo sapiens
cucucgugggguccaagacuagccc

SEQ ID NO: 762 - RNA, 25 nt, Homo sapiens
ggcugaggaacgauucucucucgug

SEQ ID NO: 763 - RNA, 25 nt, Homo sapiens
aggcugaggaacgauucucucucgu

SEQ ID NO: 764 - RNA, 25 nt, Homo sapiens
gaggcugaggaacgauucucucucg

SEQ ID NO: 765 - RNA, 25 nt, Homo sapiens
ucccgcggaguucaccaugaggcug

SEQ ID NO: 766 - RNA, 25 nt, Homo sapiens
ccgaccucccgcggaguucaccaug

SEQ ID NO: 767 - RNA, 25 nt, Homo sapiens
gaggaagcagcaauauuuuaggacu

SEQ ID NO: 768 - RNA, 25 nt, Homo sapiens
agaggaagcagcaauauuuuaggac

SEQ ID NO: 769 - RNA, 25 nt, Homo sapiens
aaggaagaggaagcagcaauauuuu

SEQ ID NO: 770 - RNA, 25 nt, Homo sapiens
acuacugaugaugcuucaaaggaag

SEQ ID NO: 771 - RNA, 25 nt, Homo sapiens
ggugugacuacugaugaugcuucaa

SEQ ID NO: 772 - RNA, 25 nt, Homo sapiens
uggcaagagggcaggccagcuguga

SEQ ID NO: 773 - RNA, 25 nt, Homo sapiens
cuggcaagagggcaggccagcugug

SEQ ID NO: 774 - RNA, 25 nt, Homo sapiens
caaauaaauauccuggcaagagggc

SEQ ID NO: 775 - RNA, 25 nt, Homo sapiens
agcacaaauaaauauccuggcaaga

SEQ ID NO: 776 - RNA, 25 nt, Homo sapiens
uagcacaaauaaauauccuggcaag

SEQ ID NO: 777 - RNA, 25 nt, Homo sapiens
gagugaauagcacaaauaaauaucc

SEQ ID NO: 778 - RNA, 25 nt, Homo sapiens
acggagaaguuacauccaaagggaa

SEQ ID NO: 779 - RNA, 25 nt, Homo sapiens
aacggagaaguuacauccaaaggga

SEQ ID NO: 780 - RNA, 25 nt, Homo sapiens
acugaacggagaaguuacauccaaa

SEQ ID NO: 781 - RNA, 25 nt, Homo sapiens
aacugaacggagaaguuacauccaa

SEQ ID NO: 782 - RNA, 25 nt, Homo sapiens
caugcaagaaaaggagggaacugaa

SEQ ID NO: 783 - RNA, 25 nt, Homo sapiens
ggacaacuuacaugcaagaaaagga

SEQ ID NO: 784 - RNA, 25 nt, Homo sapiens
gggacaacuuacaugcaagaaaagg

SEQ ID NO: 785 - RNA, 25 nt, Homo sapiens
ugggggacaacuuacaugcaagaaa

SEQ ID NO: 786 - RNA, 25 nt, Homo sapiens
aaguagauggaauacuuugggaugg

SEQ ID NO: 787 - RNA, 25 nt, Homo sapiens
aaaguagauggaauacuuugggaug

SEQ ID NO: 788 - RNA, 25 nt, Homo sapiens
aaaaguagauggaauacuuugggau

SEQ ID NO: 789 - RNA, 25 nt, Homo sapiens
gaaaaguagauggaauacuuuggga

SEQ ID NO: 790 - RNA, 25 nt, Homo sapiens
gauagaaaaguagauggaauacuuu

SEQ ID NO: 791 - RNA, 25 nt, Homo sapiens
cgauagaaaaguagauggaauacuu

SEQ ID NO: 792 - RNA, 25 nt, Homo sapiens
aaggggacggcgauagaaaaguaga

SEQ ID NO: 793 - RNA, 25 nt, Homo sapiens
ccccagagagggcugcaaaagggga

SEQ ID NO: 794 - RNA, 25 nt, Homo sapiens
ccauccccagagagggcugcaaaag

SEQ ID NO: 795 - RNA, 25 nt, Homo sapiens
uccauccccagagagggcugcaaaa

SEQ ID NO: 796 - RNA, 25 nt, Homo sapiens
guccauccccagagagggcugcaaa

SEQ ID NO: 797 - RNA, 25 nt, Homo sapiens
cauuuacccaguccauccccagaga

SEQ ID NO: 798 - RNA, 25 nt, Homo sapiens
acauuuacccaguccauccccagag

SEQ ID NO: 799 - RNA, 25 nt, Homo sapiens
agggccaggaucugugaacggggca

SEQ ID NO: 800 - RNA, 25 nt, Homo sapiens
cagggccaggaucugugaacggggc

SEQ ID NO: 801 - RNA, 25 nt, Homo sapiens
ggcucagggccaggaucugugaacg

SEQ ID NO: 802 - RNA, 25 nt, Homo sapiens
uggcucagggccaggaucugugaac

SEQ ID NO: 803 - RNA, 25 nt, Homo sapiens
cuggcucagggccaggaucugugaa

SEQ ID NO: 804 - RNA, 25 nt, Homo sapiens
aggagcacagggcuggcucagggcc

SEQ ID NO: 805 - RNA, 25 nt, Homo sapiens
gagggaggagcacagggcuggcuca

SEQ ID NO: 806 - RNA, 25 nt, Homo sapiens
ggagggaggagcacagggcuggcuc

SEQ ID NO: 807 - RNA, 25 nt, Homo sapiens
guugggggagggaggagcacagggc

SEQ ID NO: 808 - RNA, 25 nt, Homo sapiens
gaguguugggggagggaggagcaca

SEQ ID NO: 809 - RNA, 25 nt, Homo sapiens
ggaguguugggggagggaggagcac

SEQ ID NO: 810 - RNA, 25 nt, Homo sapiens
guugguagggaguguugggggaggg

SEQ ID NO: 811 - RNA, 25 nt, Homo sapiens
gggguugguagggaguguuggggga

SEQ ID NO: 812 - RNA, 25 nt, Homo sapiens
ggggguugguagggaguguuggggg

SEQ ID NO: 813 - RNA, 25 nt, Homo sapiens
uuaggggguugguagggaguguugg

SEQ ID NO: 814 - RNA, 25 nt, Homo sapiens
auuaggggguugguagggaguguug

SEQ ID NO: 815 - RNA, 25 nt, Homo sapiens
gauuaggggguugguagggaguguu

SEQ ID NO: 816 - RNA, 25 nt, Homo sapiens
ggauuaggggguugguagggagugu

SEQ ID NO: 817 - RNA, 25 nt, Homo sapiens
ggaguaggggauuaggggguuggua

SEQ ID NO: 818 - RNA, 25 nt, Homo sapiens
gggaguaggggauuaggggguuggu

SEQ ID NO: 819 - RNA, 25 nt, Homo sapiens
uggagggaguaggggauuagggggu

SEQ ID NO: 820 - RNA, 25 nt, Homo sapiens
gggguggagggaguaggggauuagg

SEQ ID NO: 821 - RNA, 25 nt, Homo sapiens
ggggguggagggaguaggggauuag

SEQ ID NO: 822 - RNA, 25 nt, Homo sapiens
gggggguggagggaguaggggauua

SEQ ID NO: 823 - RNA, 25 nt, Homo sapiens
ggggggguggagggaguaggggauu

SEQ ID NO: 824 - RNA, 25 nt, Homo sapiens
aguggaggggggguggagggaguag

SEQ ID NO: 825 - RNA, 25 nt, Homo sapiens
caguggaggggggguggagggagua

SEQ ID NO: 826 - RNA, 25 nt, Homo sapiens
acaguggaggggggguggagggagu

SEQ ID NO: 827 - RNA, 25 nt, Homo sapiens
uggccuacaguggagggggggugga

SEQ ID NO: 828 - RNA, 25 nt, Homo sapiens
guggccuacaguggagggggggugg

SEQ ID NO: 829 - RNA, 25 nt, Homo sapiens
ccaguggccuacaguggaggggggg

SEQ ID NO: 830 - RNA, 25 nt, Homo sapiens
cauccaguggccuacaguggagggg

SEQ ID NO: 831 - RNA, 25 nt, Homo sapiens
ccauccaguggccuacaguggaggg

SEQ ID NO: 832 - RNA, 25 nt, Homo sapiens
accauccaguggccuacaguggagg

SEQ ID NO: 833 - RNA, 25 nt, Homo sapiens
gaccauccaguggccuacaguggag

SEQ ID NO: 834 - RNA, 25 nt, Homo sapiens
ugaccauccaguggccuacagugga

SEQ ID NO: 835 - RNA, 25 nt, Homo sapiens
augaccauccaguggccuacagugg

SEQ ID NO: 836 - RNA, 25 nt, Homo sapiens
caaaugaccauccaguggccuacag

SEQ ID NO: 837 - RNA, 25 nt, Homo sapiens
uacggagaugcaaaugaccauccag

SEQ ID NO: 838 - RNA, 25 nt, Homo sapiens
ucagcugaggagcagagcacauuua

SEQ ID NO: 839 - RNA, 25 nt, Homo sapiens
aguuuauuuuuuucucucucagcug

SEQ ID NO: 840 - RNA, 25 nt, Homo sapiens
aggcuggcuggcuggcuggcugcua

SEQ ID NO: 841 - RNA, 25 nt, Homo sapiens
ggcuggcuggcuggcuggcugcuaa

SEQ ID NO: 842 - RNA, 25 nt, Homo sapiens
gcuaagggcugcuccacgcuuuugc

SEQ ID NO: 843 - RNA, 25 nt, Homo sapiens
aagggcugcuccacgcuuuugccgg

SEQ ID NO: 844 - RNA, 25 nt, Homo sapiens
uuuugccggaggacagagacugaca

SEQ ID NO: 845 - RNA, 25 nt, Homo sapiens
cggaggacagagacugacauggaac

SEQ ID NO: 846 - RNA, 25 nt, Homo sapiens
ggaggacagagacugacauggaaca

SEQ ID NO: 847 - RNA, 25 nt, Homo sapiens
gaggacagagacugacauggaacag

SEQ ID NO: 848 - RNA, 25 nt, Homo sapiens
acagagacugacauggaacagggga

SEQ ID NO: 849 - RNA, 25 nt, Homo sapiens
cagagacugacauggaacaggggaa

SEQ ID NO: 850 - RNA, 25 nt, Homo sapiens
acugacauggaacaggggaagggcc

SEQ ID NO: 851 - RNA, 25 nt, Homo sapiens
gggaagggccuggcuguccucaucc

SEQ ID NO: 852 - RNA, 25 nt, Homo sapiens
ucauccuggcuaucauucuucuuca

SEQ ID NO: 853 - RNA, 25 nt, Homo sapiens
cuggcuaucauucuucuucaaggua

SEQ ID NO: 854 - RNA, 25 nt, Homo sapiens
uggcuaucauucuucuucaagguaa

SEQ ID NO: 855 - RNA, 25 nt, Homo sapiens
uucuucuucaagguaagggccuacu

SEQ ID NO: 856 - RNA, 25 nt, Homo sapiens
ucuucuucaagguaagggccuacua

SEQ ID NO: 857 - RNA, 25 nt, Homo sapiens
cuucuucaagguaagggccuacuag

SEQ ID NO: 858 - RNA, 25 nt, Homo sapiens
ucaagguaagggccuacuagggguc

SEQ ID NO: 859 - RNA, 25 nt, Homo sapiens
ucacuggcuccacccaucacuguug

SEQ ID NO: 860 - RNA, 25 nt, Homo sapiens
aucacuggcuccacccaucacuguu

SEQ ID NO: 861 - RNA, 25 nt, Homo sapiens
gaucacuggcuccacccaucacugu

SEQ ID NO: 862 - RNA, 25 nt, Homo sapiens
gucggucggacacgucgucgaucac

SEQ ID NO: 863 - RNA, 25 nt, Homo sapiens
cagucucuguccuccggcaaaagcg

SEQ ID NO: 864 - RNA, 25 nt, Homo sapiens
cuguuccaugucagucucuguccuc

SEQ ID NO: 865 - RNA, 25 nt, Homo sapiens
aaugauagccaggaugaggacagcc

SEQ ID NO: 866 - RNA, 25 nt, Homo sapiens
uugaagaagaaugauagccaggaug

SEQ ID NO: 867 - RNA, 25 nt, Homo sapiens
cuuaccuugaagaagaaugauagcc

SEQ ID NO: 868 - RNA, 25 nt, Homo sapiens
cucucuucugucuuuacagguacuu

SEQ ID NO: 869 - RNA, 25 nt, Homo sapiens
cagguacuuuggcccagucaaucaa

SEQ ID NO: 870 - RNA, 25 nt, Homo sapiens
uacuuuggcccagucaaucaaaggu

SEQ ID NO: 871 - RNA, 25 nt, Homo sapiens
cccagucaaucaaagguaggagaaa

SEQ ID NO: 872 - RNA, 25 nt, Homo sapiens
ccauuucuccuaccuuugauugacu

SEQ ID NO: 873 - RNA, 25 nt, Homo sapiens
gccauuucuccuaccuuugauugac

SEQ ID NO: 874 - RNA, 25 nt, Homo sapiens
gcuuuucucauuucaggaaaccacu

SEQ ID NO: 875 - RNA, 25 nt, Homo sapiens
cucauuucaggaaaccacuugguua

SEQ ID NO: 876 - RNA, 25 nt, Homo sapiens
uuaagguguaugacuaucaagaaga

SEQ ID NO: 877 - RNA, 25 nt, Homo sapiens
guguaugacuaucaagaagaugguu

SEQ ID NO: 878 - RNA, 25 nt, Homo sapiens
ugaugcagaagccaaaaauaucaca

SEQ ID NO: 879 - RNA, 25 nt, Homo sapiens
ccaaaaauaucacaugguuuaaaga

SEQ ID NO: 880 - RNA, 25 nt, Homo sapiens
caaaaauaucacaugguuuaaagau

SEQ ID NO: 881 - RNA, 25 nt, Homo sapiens
caugguuuaaagaugggaagaugau

SEQ ID NO: 882 - RNA, 25 nt, Homo sapiens
cuuccuaacugaagauaaaaaaaaa

SEQ ID NO: 883 - RNA, 25 nt, Homo sapiens
acugaagauaaaaaaaaauggaauc

SEQ ID NO: 884 - RNA, 25 nt, Homo sapiens
cugaagauaaaaaaaaauggaaucu

SEQ ID NO: 885 - RNA, 25 nt, Homo sapiens
aaauggaaucugggaaguaaugcca

SEQ ID NO: 886 - RNA, 25 nt, Homo sapiens
ugggaaguaaugccaaggacccucg

SEQ ID NO: 887 - RNA, 25 nt, Homo sapiens
gggaaguaaugccaaggacccucga

SEQ ID NO: 888 - RNA, 25 nt, Homo sapiens
acccucgagggauguaucaguguaa

SEQ ID NO: 889 - RNA, 25 nt, Homo sapiens
uauuacagaaguauguaauccccuu

SEQ ID NO: 890 - RNA, 25 nt, Homo sapiens
ugguuuccugaaaugagaaaagccg

SEQ ID NO: 891 - RNA, 25 nt, Homo sapiens
uugauagucauacaccuuaaccaag

SEQ ID NO: 892 - RNA, 25 nt, Homo sapiens
ccaucuuuaaaccaugugauauuuu

SEQ ID NO: 893 - RNA, 25 nt, Homo sapiens
auuccauuuuuuuuuaucuucaguu

SEQ ID NO: 894 - RNA, 25 nt, Homo sapiens
cacugauacaucccucgaggguccu

SEQ ID NO: 895 - RNA, 25 nt, Homo sapiens
uccuuuacacugauacaucccucga

SEQ ID NO: 896 - RNA, 25 nt, Homo sapiens
auccuuuacacugauacaucccucg

SEQ ID NO: 897 - RNA, 25 nt, Homo sapiens
acauacuucuguaauacacuuggag

SEQ ID NO: 898 - RNA, 25 nt, Homo sapiens
ggauuacauacuucuguaauacacu

SEQ ID NO: 899 - RNA, 25 nt, Homo sapiens
uugaacuaaaugcagccaccauauc

SEQ ID NO: 900 - RNA, 25 nt, Homo sapiens
ucgucagcauuuucguccuugcugu

SEQ ID NO: 901 - RNA, 25 nt, Homo sapiens
cgucagcauuuucguccuugcuguu

SEQ ID NO: 902 - RNA, 25 nt, Homo sapiens
gucagcauuuucguccuugcuguug

SEQ ID NO: 903 - RNA, 25 nt, Homo sapiens
uugcuguuggggucuacuucauugc

SEQ ID NO: 904 - RNA, 25 nt, Homo sapiens
guuggggucuacuucauugcuggac

SEQ ID NO: 905 - RNA, 25 nt, Homo sapiens
gggucuacuucauugcuggacagga

SEQ ID NO: 906 - RNA, 25 nt, Homo sapiens
gacaggauggaguucgccagucgag

SEQ ID NO: 907 - RNA, 25 nt, Homo sapiens
gcaguucugacacacuguagggaaa

SEQ ID NO: 908 - RNA, 25 nt, Homo sapiens
uucaaugcaguucugacacacugua

SEQ ID NO: 909 - RNA, 25 nt, Homo sapiens
guucaaugcaguucugacacacugu

SEQ ID NO: 910 - RNA, 25 nt, Homo sapiens
ucagcaaagagaaagccagauaugg

SEQ ID NO: 911 - RNA, 25 nt, Homo sapiens
auuucagcaaagagaaagccagaua

SEQ ID NO: 912 - RNA, 25 nt, Homo sapiens
agcaaugaaguagaccccaacagca

SEQ ID NO: 913 - RNA, 25 nt, Homo sapiens
uaagagcauucuuuuaccucucgac

SEQ ID NO: 914 - RNA, 25 nt, Homo sapiens
cuguugcccaaugaccagcucuacc

SEQ ID NO: 915 - RNA, 25 nt, Homo sapiens
gcccaaugaccagcucuaccaggua

SEQ ID NO: 916 - RNA, 25 nt, Homo sapiens
cccaaugaccagcucuaccagguaa

SEQ ID NO: 917 - RNA, 25 nt, Homo sapiens
ccaaugaccagcucuaccagguaag

SEQ ID NO: 918 - RNA, 25 nt, Homo sapiens
cccuuaccugguagagcuggucauu

SEQ ID NO: 919 - RNA, 25 nt, Homo sapiens
ccccuuaccugguagagcuggucau

SEQ ID NO: 920 - RNA, 25 nt, Homo sapiens
ucuucauccccuuaccugguagagc

SEQ ID NO: 921 - RNA, 25 nt, Homo sapiens
cucuuuuauucuucauccccuuacc

SEQ ID NO: 922 - RNA, 25 nt, Homo sapiens
cugugcuguccuuuccagccccuca

SEQ ID NO: 923 - RNA, 25 nt, Homo sapiens
aagaugaccaguacagccaccuuca

SEQ ID NO: 924 - RNA, 25 nt, Homo sapiens
cagccaccuucaaggaaaccaguug

SEQ ID NO: 925 - RNA, 25 nt, Homo sapiens
ccaccuucaaggaaaccaguugagg

SEQ ID NO: 926 - RNA, 25 nt, Homo sapiens
aaccaguugaggaggaauugaacuc

SEQ ID NO: 927 - RNA, 25 nt, Homo sapiens
aggaauugaacucaggacucagagu

SEQ ID NO: 928 - RNA, 25 nt, Homo sapiens
aauugaacucaggacucagaguagg

SEQ ID NO: 929 - RNA, 25 nt, Homo sapiens
auugaacucaggacucagaguaggu

SEQ ID NO: 930 - RNA, 25 nt, Homo sapiens
cuucucgauccuugaggggcuggaa

SEQ ID NO: 931 - RNA, 25 nt, Homo sapiens
gucaucuucucgauccuugaggggc

SEQ ID NO: 932 - RNA, 25 nt, Homo sapiens
acuggucaucuucucgauccuugag

SEQ ID NO: 933 - RNA, 25 nt, Homo sapiens
uacuggucaucuucucgauccuuga

SEQ ID NO: 934 - RNA, 25 nt, Homo sapiens
guacuggucaucuucucgauccuug

SEQ ID NO: 935 - RNA, 25 nt, Homo sapiens
cugguuuccuugaagguggcuguac

SEQ ID NO: 936 - RNA, 25 nt, Homo sapiens
ccuccucaacugguuuccuugaagg

SEQ ID NO: 937 - RNA, 25 nt, Homo sapiens
auuccuccucaacugguuuccuuga

SEQ ID NO: 938 - RNA, 25 nt, Homo sapiens
guccugaguucaauuccuccucaac

SEQ ID NO: 939 - RNA, 25 nt, Homo sapiens
auugcaauuuuucuuuuuucagucc

SEQ ID NO: 940 - RNA, 25 nt, Homo sapiens
uucccagaaucaaagcaaugcauuu

SEQ ID NO: 941 - RNA, 25 nt, Homo sapiens
acuuucagcccuaaaucuagacuca

SEQ ID NO: 942 - RNA, 25 nt, Homo sapiens
acucaagguucccagagaugacaaa

SEQ ID NO: 943 - RNA, 25 nt, Homo sapiens
cccagagaugacaaauggagaagaa

SEQ ID NO: 944 - RNA, 25 nt, Homo sapiens
agaagaaaggccaucagagcaaauu

SEQ ID NO: 945 - RNA, 25 nt, Homo sapiens
gaagaaaggccaucagagcaaauuu

SEQ ID NO: 946 - RNA, 25 nt, Homo sapiens
aagaaaggccaucagagcaaauuug

SEQ ID NO: 947 - RNA, 25 nt, Homo sapiens
agaaaggccaucagagcaaauuugg

SEQ ID NO: 948 - RNA, 25 nt, Homo sapiens
acuguguuucagaagcgccaccuau

SEQ ID NO: 949 - RNA, 25 nt, Homo sapiens
cuguguuucagaagcgccaccuauu

SEQ ID NO: 950 - RNA, 25 nt, Homo sapiens
uguguuucagaagcgccaccuauug

SEQ ID NO: 951 - RNA, 25 nt, Homo sapiens
aaaaugaaaagaucaaauaaccccc

SEQ ID NO: 952 - RNA, 25 nt, Homo sapiens
gggaacugaauaggaggagaacacc

SEQ ID NO: 953 - RNA, 25 nt, Homo sapiens
gcuuugauucugggaacugaauagg

SEQ ID NO: 954 - RNA, 25 nt, Homo sapiens
auugcuuugauucugggaacugaau

SEQ ID NO: 955 - RNA, 25 nt, Homo sapiens
uuccaaaaugcauugcuuugauucu

SEQ ID NO: 956 - RNA, 25 nt, Homo sapiens
uuuccaaaaugcauugcuuugauuc

SEQ ID NO: 957 - RNA, 25 nt, Homo sapiens
auuuagggcugaaagucucucugcu

SEQ ID NO: 958 - RNA, 25 nt, Homo sapiens
ucugggaaccuugagucuagauuua

SEQ ID NO: 959 - RNA, 25 nt, Homo sapiens
cucugggaaccuugagucuagauuu

SEQ ID NO: 960 - RNA, 25 nt, Homo sapiens
ccuuucuucuccauuugucaucucu

SEQ ID NO: 961 - RNA, 25 nt, Homo sapiens
gccuuucuucuccauuugucaucuc

SEQ ID NO: 962 - RNA, 25 nt, Homo sapiens
ugagaaacccccaaauuugcucuga

SEQ ID NO: 963 - RNA, 25 nt, Homo sapiens
uucuuuuacaauuuuccccaauagg

SEQ ID NO: 964 - RNA, 25 nt, Homo sapiens
uuuuucuuuuacaauuuuccccaau

SEQ ID NO: 965 - RNA, 25 nt, Homo sapiens
acaaaaaauuauauucaaauccagg

SEQ ID NO: 966 - RNA, 25 nt, Homo sapiens
cacaaaaaauuauauucaaauccag

SEQ ID NO: 967 - RNA, 25 nt, Homo sapiens
acacaaaaaauuauauucaaaucca

SEQ ID NO: 968 - RNA, 25 nt, Homo sapiens
aacacaaaaaauuauauucaaaucc

SEQ ID NO: 969 - RNA, 25 nt, Homo sapiens
ccagagaagccaaucagugucgucg

SEQ ID NO: 970 - RNA, 25 nt, Homo sapiens
uguucuaaagcccgcacgcacccac

SEQ ID NO: 971 - RNA, 25 nt, Homo sapiens
guucuaaagcccgcacgcacccacc

SEQ ID NO: 972 - RNA, 25 nt, Homo sapiens
ggacucagauucuccccagacgccg

SEQ ID NO: 973 - RNA, 25 nt, Homo sapiens
ucagauucuccccagacgccgagga

SEQ ID NO: 974 - RNA, 25 nt, Homo sapiens
ccccagacgccgaggauggccguca

SEQ ID NO: 975 - RNA, 25 nt, Homo sapiens
ccccgaacccuccuccugcuacucu

SEQ ID NO: 976 - RNA, 25 nt, Homo sapiens
cccgaacccuccuccugcuacucuc

SEQ ID NO: 977 - RNA, 25 nt, Homo sapiens
ccgaacccuccuccugcuacucucg

SEQ ID NO: 978 - RNA, 25 nt, Homo sapiens
cgaacccuccuccugcuacucucgg

SEQ ID NO: 979 - RNA, 25 nt, Homo sapiens
cuccuccugcuacucucgggggccc

SEQ ID NO: 980 - RNA, 25 nt, Homo sapiens
gggggcccuggcccugacccagacc

SEQ ID NO: 981 - RNA, 25 nt, Homo sapiens
ggggcccuggcccugacccagaccu

SEQ ID NO: 982 - RNA, 25 nt, Homo sapiens
gcccuggcccugacccagaccuggg

SEQ ID NO: 983 - RNA, 25 nt, Homo sapiens
cccuggcccugacccagaccugggc

SEQ ID NO: 984 - RNA, 25 nt, Homo sapiens
ugacccagaccugggcgggugagug

SEQ ID NO: 985 - RNA, 25 nt, Homo sapiens
gacccagaccugggcgggugagugc

SEQ ID NO: 986 - RNA, 25 nt, Homo sapiens
acccagaccugggcgggugagugcg

SEQ ID NO: 987 - RNA, 25 nt, Homo sapiens
agaccugggcgggugagugcggggu

SEQ ID NO: 988 - RNA, 25 nt, Homo sapiens
gaccugggcgggugagugcgggguc

SEQ ID NO: 989 - RNA, 25 nt, Homo sapiens
cugggcgggugagugcggggucggg

SEQ ID NO: 990 - RNA, 25 nt, Homo sapiens
ugggcgggugagugcggggucggga

SEQ ID NO: 991 - RNA, 25 nt, Homo sapiens
cuucucuggaaacccgacacccaau

SEQ ID NO: 992 - RNA, 25 nt, Homo sapiens
gcuucucuggaaacccgacacccaa

SEQ ID NO: 993 - RNA, 25 nt, Homo sapiens
ccgcgacgacacugauuggcuucuc

SEQ ID NO: 994 - RNA, 25 nt, Homo sapiens
gaacagcgaccgcgacgacacugau

SEQ ID NO: 995 - RNA, 25 nt, Homo sapiens
aaucugagucccggugggugcgugc

SEQ ID NO: 996 - RNA, 25 nt, Homo sapiens
gaaucugagucccggugggugcgug

SEQ ID NO: 997 - RNA, 25 nt, Homo sapiens
gucuggggagaaucugagucccggu

SEQ ID NO: 998 - RNA, 25 nt, Homo sapiens
cgucuggggagaaucugagucccgg

SEQ ID NO: 999 - RNA, 25 nt, Homo sapiens
cggcgucuggggagaaucugagucc

SEQ ID NO: 1000 - RNA, 25 nt, Homo sapiens
ccaugacggccauccucggcgucug

SEQ ID NO: 1001 - RNA, 25 nt, Homo sapiens
gccaugacggccauccucggcgucu

SEQ ID NO: 1002 - RNA, 25 nt, Homo sapiens
cgccaugacggccauccucggcguc

SEQ ID NO: 1003 - RNA, 25 nt, Homo sapiens
uucggggcgccaugacggccauccu

SEQ ID NO: 1004 - RNA, 25 nt, Homo sapiens
aggaggaggguucggggcgccauga

SEQ ID NO: 1005 - RNA, 25 nt, Homo sapiens
ccgagaguagcaggaggaggguucg

SEQ ID NO: 1006 - RNA, 25 nt, Homo sapiens
cccgagaguagcaggaggaggguuc

SEQ ID NO: 1007 - RNA, 25 nt, Homo sapiens
ccccgagaguagcaggaggaggguu

SEQ ID NO: 1008 - RNA, 25 nt, Homo sapiens
agggcccccgagaguagcaggagga

SEQ ID NO: 1009 - RNA, 25 nt, Homo sapiens
cagggcccccgagaguagcaggagg

SEQ ID NO: 1010 - RNA, 25 nt, Homo sapiens
ggccagggcccccgagaguagcagg

SEQ ID NO: 1011 - RNA, 25 nt, Homo sapiens
cagggccagggcccccgagaguagc

SEQ ID NO: 1012 - RNA, 25 nt, Homo sapiens
cccgcccaggucugggucagggcca

SEQ ID NO: 1013 - RNA, 25 nt, Homo sapiens
acccgcccaggucugggucagggcc

SEQ ID NO: 1014 - RNA, 25 nt, Homo sapiens
cacucacccgcccaggucuggguca

SEQ ID NO: 1015 - RNA, 25 nt, Homo sapiens
gcacucacccgcccaggucuggguc

SEQ ID NO: 1016 - RNA, 25 nt, Homo sapiens
accccgcacucacccgcccaggucu

SEQ ID NO: 1017 - RNA, 25 nt, Homo sapiens
gaccccgcacucacccgcccagguc

SEQ ID NO: 1018 - RNA, 25 nt, Homo sapiens
cucccgaccccgcacucacccgccc

SEQ ID NO: 1019 - RNA, 25 nt, Homo sapiens
cucgcccccaggcucccacuccaug

SEQ ID NO: 1020 - RNA, 25 nt, Homo sapiens
gagguauuucuucacauccgugucc

SEQ ID NO: 1021 - RNA, 25 nt, Homo sapiens
auuucuucacauccgugucccggcc

SEQ ID NO: 1022 - RNA, 25 nt, Homo sapiens
ucacauccgugucccggcccggccg

SEQ ID NO: 1023 - RNA, 25 nt, Homo sapiens
cacauccgugucccggcccggccgc

SEQ ID NO: 1024 - RNA, 25 nt, Homo sapiens
acauccgugucccggcccggccgcg

SEQ ID NO: 1025 - RNA, 25 nt, Homo sapiens
cgcggggagccccgcuucaucgccg

SEQ ID NO: 1026 - RNA, 25 nt, Homo sapiens
gcggggagccccgcuucaucgccgu

SEQ ID NO: 1027 - RNA, 25 nt, Homo sapiens
ccccgcuucaucgccgugggcuacg

SEQ ID NO: 1028 - RNA, 25 nt, Homo sapiens
cuacguggacgacacgcaguucgug

SEQ ID NO: 1029 - RNA, 25 nt, Homo sapiens
guucgacagcgacgccgcgagccag

SEQ ID NO: 1030 - RNA, 25 nt, Homo sapiens
gacagcgacgccgcgagccagagga

SEQ ID NO: 1031 - RNA, 25 nt, Homo sapiens
cgccgcgagccagaggauggagccg

SEQ ID NO: 1032 - RNA, 25 nt, Homo sapiens
gccgcgagccagaggauggagccgc

SEQ ID NO: 1033 - RNA, 25 nt, Homo sapiens
ccagaggauggagccgcgggcgccg

SEQ ID NO: 1034 - RNA, 25 nt, Homo sapiens
gagccgcgggcgccguggauagagc

SEQ ID NO: 1035 - RNA, 25 nt, Homo sapiens
ccgcgggcgccguggauagagcagg

SEQ ID NO: 1036 - RNA, 25 nt, Homo sapiens
cgcgggcgccguggauagagcagga

SEQ ID NO: 1037 - RNA, 25 nt, Homo sapiens
gcgggcgccguggauagagcaggag

SEQ ID NO: 1038 - RNA, 25 nt, Homo sapiens
gcgccguggauagagcaggaggggc

SEQ ID NO: 1039 - RNA, 25 nt, Homo sapiens
gauagagcaggaggggccggaguau

SEQ ID NO: 1040 - RNA, 25 nt, Homo sapiens
auagagcaggaggggccggaguauu

SEQ ID NO: 1041 - RNA, 25 nt, Homo sapiens
caggaggggccggaguauugggacc

SEQ ID NO: 1042 - RNA, 25 nt, Homo sapiens
gccggaguauugggaccaggagaca

SEQ ID NO: 1043 - RNA, 25 nt, Homo sapiens
ugggaccaggagacacggaauguga

SEQ ID NO: 1044 - RNA, 25 nt, Homo sapiens
aaggcccagucacagacugaccgag

SEQ ID NO: 1045 - RNA, 25 nt, Homo sapiens
cagucacagacugaccgaguggacc

SEQ ID NO: 1046 - RNA, 25 nt, Homo sapiens
agucacagacugaccgaguggaccu

SEQ ID NO: 1047 - RNA, 25 nt, Homo sapiens
gucacagacugaccgaguggaccug

SEQ ID NO: 1048 - RNA, 25 nt, Homo sapiens
accgaguggaccuggggacccugcg

SEQ ID NO: 1049 - RNA, 25 nt, Homo sapiens
cugcgcggcuacuacaaccagagcg

SEQ ID NO: 1050 - RNA, 25 nt, Homo sapiens
gcggcuacuacaaccagagcgaggc

SEQ ID NO: 1051 - RNA, 25 nt, Homo sapiens
ccagagcgaggccggugagugaccc

SEQ ID NO: 1052 - RNA, 25 nt, Homo sapiens
agcgaggccggugagugaccccggc

SEQ ID NO: 1053 - RNA, 25 nt, Homo sapiens
gcgaggccggugagugaccccggcc

SEQ ID NO: 1054 - RNA, 25 nt, Homo sapiens
cgaggccggugagugaccccggccg

SEQ ID NO: 1055 - RNA, 25 nt, Homo sapiens
gaggccggugagugaccccggccgg

SEQ ID NO: 1056 - RNA, 25 nt, Homo sapiens
ggagugggagccugggggcgagcag

SEQ ID NO: 1057 - RNA, 25 nt, Homo sapiens
aauaccucauggagugggagccugg

SEQ ID NO: 1058 - RNA, 25 nt, Homo sapiens
aaauaccucauggagugggagccug

SEQ ID NO: 1059 - RNA, 25 nt, Homo sapiens
gaaauaccucauggagugggagccu

SEQ ID NO: 1060 - RNA, 25 nt, Homo sapiens
agaaauaccucauggagugggagcc

SEQ ID NO: 1061 - RNA, 25 nt, Homo sapiens
gaugugaagaaauaccucauggagu

SEQ ID NO: 1062 - RNA, 25 nt, Homo sapiens
ggaugugaagaaauaccucauggag

SEQ ID NO: 1063 - RNA, 25 nt, Homo sapiens
gacacggaugugaagaaauaccuca

SEQ ID NO: 1064 - RNA, 25 nt, Homo sapiens
ggcuccccgcggccgggccgggaca

SEQ ID NO: 1065 - RNA, 25 nt, Homo sapiens
aagcggggcuccccgcggccgggcc

SEQ ID NO: 1066 - RNA, 25 nt, Homo sapiens
gaagcggggcuccccgcggccgggc

SEQ ID NO: 1067 - RNA, 25 nt, Homo sapiens
cgaugaagcggggcuccccgcggcc

SEQ ID NO: 1068 - RNA, 25 nt, Homo sapiens
gcgaugaagcggggcuccccgcggc

SEQ ID NO: 1069 - RNA, 25 nt, Homo sapiens
cacggcgaugaagcggggcuccccg

SEQ ID NO: 1070 - RNA, 25 nt, Homo sapiens
ccacguagcccacggcgaugaagcg

SEQ ID NO: 1071 - RNA, 25 nt, Homo sapiens
uccacguagcccacggcgaugaagc

SEQ ID NO: 1072 - RNA, 25 nt, Homo sapiens
guccacguagcccacggcgaugaag

SEQ ID NO: 1073 - RNA, 25 nt, Homo sapiens
aacugcgugucguccacguagccca

SEQ ID NO: 1074 - RNA, 25 nt, Homo sapiens
gcccgcggcuccauccucuggcucg

SEQ ID NO: 1075 - RNA, 25 nt, Homo sapiens
ccacggcgcccgcggcuccauccuc

SEQ ID NO: 1076 - RNA, 25 nt, Homo sapiens
ccuccugcucuauccacggcgcccg

SEQ ID NO: 1077 - RNA, 25 nt, Homo sapiens
acuccggccccuccugcucuaucca

SEQ ID NO: 1078 - RNA, 25 nt, Homo sapiens
uccgugucuccuggucccaauacuc

SEQ ID NO: 1079 - RNA, 25 nt, Homo sapiens
cugggccuucacauuccgugucucc

SEQ ID NO: 1080 - RNA, 25 nt, Homo sapiens
agguccacucggucagucugugacu

SEQ ID NO: 1081 - RNA, 25 nt, Homo sapiens
cagguccacucggucagucugugac

SEQ ID NO: 1082 - RNA, 25 nt, Homo sapiens
gccgcgcaggguccccagguccacu

SEQ ID NO: 1083 - RNA, 25 nt, Homo sapiens
guuguaguagccgcgcagggucccc

SEQ ID NO: 1084 - RNA, 25 nt, Homo sapiens
ucgcucugguuguaguagccgcgca

SEQ ID NO: 1085 - RNA, 25 nt, Homo sapiens
cucgcucugguuguaguagccgcgc

SEQ ID NO: 1086 - RNA, 25 nt, Homo sapiens
ccggggucacucaccggccucgcuc

SEQ ID NO: 1087 - RNA, 25 nt, Homo sapiens
ugcgcccccggccggggucacucac

SEQ ID NO: 1088 - RNA, 25 nt, Homo sapiens
guucucacaccauccagauaaugua

SEQ ID NO: 1089 - RNA, 25 nt, Homo sapiens
auccagauaauguauggcugcgacg

SEQ ID NO: 1090 - RNA, 25 nt, Homo sapiens
uccagauaauguauggcugcgacgu

SEQ ID NO: 1091 - RNA, 25 nt, Homo sapiens
ccagauaauguauggcugcgacgug

SEQ ID NO: 1092 - RNA, 25 nt, Homo sapiens
auaauguauggcugcgacguggggu

SEQ ID NO: 1093 - RNA, 25 nt, Homo sapiens
uguauggcugcgacguggggucgga

SEQ ID NO: 1094 - RNA, 25 nt, Homo sapiens
guauggcugcgacguggggucggac

SEQ ID NO: 1095 - RNA, 25 nt, Homo sapiens
uggggucggacgggcgcuuccuccg

SEQ ID NO: 1096 - RNA, 25 nt, Homo sapiens
ggggucggacgggcgcuuccuccgc

SEQ ID NO: 1097 - RNA, 25 nt, Homo sapiens
ggacgggcgcuuccuccgcggguac

SEQ ID NO: 1098 - RNA, 25 nt, Homo sapiens
gggcgcuuccuccgcggguaccggc

SEQ ID NO: 1099 - RNA, 25 nt, Homo sapiens
gcggguaccggcaggacgccuacga

SEQ ID NO: 1100 - RNA, 25 nt, Homo sapiens
uaccggcaggacgccuacgacggca

SEQ ID NO: 1101 - RNA, 25 nt, Homo sapiens
ggcaaggauuacaucgcccugaacg

SEQ ID NO: 1102 - RNA, 25 nt, Homo sapiens
cgcccugaacgaggaccugcgcucu

SEQ ID NO: 1103 - RNA, 25 nt, Homo sapiens
aacgaggaccugcgcucuuggaccg

SEQ ID NO: 1104 - RNA, 25 nt, Homo sapiens
gaggaccugcgcucuuggaccgcgg

SEQ ID NO: 1105 - RNA, 25 nt, Homo sapiens
cugcgcucuuggaccgcggcggaca

SEQ ID NO: 1106 - RNA, 25 nt, Homo sapiens
cgcucuuggaccgcggcggacaugg

SEQ ID NO: 1107 - RNA, 25 nt, Homo sapiens
ggcggcucagaucaccaagcgcaag

SEQ ID NO: 1108 - RNA, 25 nt, Homo sapiens
gcggcucagaucaccaagcgcaagu

SEQ ID NO: 1109 - RNA, 25 nt, Homo sapiens
gcucagaucaccaagcgcaaguggg

SEQ ID NO: 1110 - RNA, 25 nt, Homo sapiens
cagaucaccaagcgcaagugggagg

SEQ ID NO: 1111 - RNA, 25 nt, Homo sapiens
aagcgcaagugggaggcggcccaug

SEQ ID NO: 1112 - RNA, 25 nt, Homo sapiens
cgcaagugggaggcggcccaugagg

SEQ ID NO: 1113 - RNA, 25 nt, Homo sapiens
gaggcggagcaguugagagccuacc

SEQ ID NO: 1114 - RNA, 25 nt, Homo sapiens
cggagcaguugagagccuaccugga

SEQ ID NO: 1115 - RNA, 25 nt, Homo sapiens
agagccuaccuggauggcacgugcg

SEQ ID NO: 1116 - RNA, 25 nt, Homo sapiens
cuaccuggauggcacgugcguggag

SEQ ID NO: 1117 - RNA, 25 nt, Homo sapiens
ugcguggaguggcuccgcagauacc

SEQ ID NO: 1118 - RNA, 25 nt, Homo sapiens
aguggcuccgcagauaccuggagaa

SEQ ID NO: 1119 - RNA, 25 nt, Homo sapiens
guggcuccgcagauaccuggagaac

SEQ ID NO: 1120 - RNA, 25 nt, Homo sapiens
cuccgcagauaccuggagaacggga

SEQ ID NO: 1121 - RNA, 25 nt, Homo sapiens
aacgggaaggagacgcugcagcgca

SEQ ID NO: 1122 - RNA, 25 nt, Homo sapiens
acgggaaggagacgcugcagcgcac

SEQ ID NO: 1123 - RNA, 25 nt, Homo sapiens
ggagacgcugcagcgcacggguacc

SEQ ID NO: 1124 - RNA, 25 nt, Homo sapiens
gagacgcugcagcgcacggguacca

SEQ ID NO: 1125 - RNA, 25 nt, Homo sapiens
agacgcugcagcgcacggguaccag

SEQ ID NO: 1126 - RNA, 25 nt, Homo sapiens
ugcagcgcacggguaccaggggcca

SEQ ID NO: 1127 - RNA, 25 nt, Homo sapiens
gcagcgcacggguaccaggggccac

SEQ ID NO: 1128 - RNA, 25 nt, Homo sapiens
cagcgcacggguaccaggggccacg

SEQ ID NO: 1129 - RNA, 25 nt, Homo sapiens
gugugagaaccuggccccgaccccg

SEQ ID NO: 1130 - RNA, 25 nt, Homo sapiens
acauuaucuggauggugugagaacc

SEQ ID NO: 1131 - RNA, 25 nt, Homo sapiens
acgucgcagccauacauuaucugga

SEQ ID NO: 1132 - RNA, 25 nt, Homo sapiens
ccccacgucgcagccauacauuauc

SEQ ID NO: 1133 - RNA, 25 nt, Homo sapiens
guaggcguccugccgguacccgcgg

SEQ ID NO: 1134 - RNA, 25 nt, Homo sapiens
gucguaggcguccugccgguacccg

SEQ ID NO: 1135 - RNA, 25 nt, Homo sapiens
auccuugccgucguaggcguccugc

SEQ ID NO: 1136 - RNA, 25 nt, Homo sapiens
agggcgauguaauccuugccgucgu

SEQ ID NO: 1137 - RNA, 25 nt, Homo sapiens
guccaagagcgcagguccucguuca

SEQ ID NO: 1138 - RNA, 25 nt, Homo sapiens
gguccaagagcgcagguccucguuc

SEQ ID NO: 1139 - RNA, 25 nt, Homo sapiens
cauguccgccgcgguccaagagcgc

SEQ ID NO: 1140 - RNA, 25 nt, Homo sapiens
gugaucugagccgccauguccgccg

SEQ ID NO: 1141 - RNA, 25 nt, Homo sapiens
ucaugggccgccucccacuugcgcu

SEQ ID NO: 1142 - RNA, 25 nt, Homo sapiens
uaggcucucaacugcuccgccucau

SEQ ID NO: 1143 - RNA, 25 nt, Homo sapiens
guaggcucucaacugcuccgccuca

SEQ ID NO: 1144 - RNA, 25 nt, Homo sapiens
cacuccacgcacgugccauccaggu

SEQ ID NO: 1145 - RNA, 25 nt, Homo sapiens
gagccacuccacgcacgugccaucc

SEQ ID NO: 1146 - RNA, 25 nt, Homo sapiens
cuccuucccguucuccagguaucug

SEQ ID NO: 1147 - RNA, 25 nt, Homo sapiens
cugcagcgucuccuucccguucucc

SEQ ID NO: 1148 - RNA, 25 nt, Homo sapiens
acccaccaccccaucucugaccaug

SEQ ID NO: 1149 - RNA, 25 nt, Homo sapiens
caucucugaccaugaggccacccug

SEQ ID NO: 1150 - RNA, 25 nt, Homo sapiens
ugaccaugaggccacccugaggugc

SEQ ID NO: 1151 - RNA, 25 nt, Homo sapiens
gaccaugaggccacccugaggugcu

SEQ ID NO: 1152 - RNA, 25 nt, Homo sapiens
gaggccacccugaggugcugggccc

SEQ ID NO: 1153 - RNA, 25 nt, Homo sapiens
aggccacccugaggugcugggcccu

SEQ ID NO: 1154 - RNA, 25 nt, Homo sapiens
ugcugggcccugggcuucuacccug

SEQ ID NO: 1155 - RNA, 25 nt, Homo sapiens
cuacccugcggagaucacacugacc

SEQ ID NO: 1156 - RNA, 25 nt, Homo sapiens
ugcggagaucacacugaccuggcag

SEQ ID NO: 1157 - RNA, 25 nt, Homo sapiens
gcggagaucacacugaccuggcagc

SEQ ID NO: 1158 - RNA, 25 nt, Homo sapiens
agaucacacugaccuggcagcggga

SEQ ID NO: 1159 - RNA, 25 nt, Homo sapiens
gaucacacugaccuggcagcgggau

SEQ ID NO: 1160 - RNA, 25 nt, Homo sapiens
aucacacugaccuggcagcgggaug

SEQ ID NO: 1161 - RNA, 25 nt, Homo sapiens
acacugaccuggcagcgggaugggg

SEQ ID NO: 1162 - RNA, 25 nt, Homo sapiens
cagcgggauggggaggaccagaccc

SEQ ID NO: 1163 - RNA, 25 nt, Homo sapiens
gauggggaggaccagacccaggaca

SEQ ID NO: 1164 - RNA, 25 nt, Homo sapiens
gaccagacccaggacacggagcucg

SEQ ID NO: 1165 - RNA, 25 nt, Homo sapiens
ccaggacacggagcucguggagacc

SEQ ID NO: 1166 - RNA, 25 nt, Homo sapiens
cggagcucguggagaccaggccugc

SEQ ID NO: 1167 - RNA, 25 nt, Homo sapiens
ggagcucguggagaccaggccugca

SEQ ID NO: 1168 - RNA, 25 nt, Homo sapiens
gagcucguggagaccaggccugcag

SEQ ID NO: 1169 - RNA, 25 nt, Homo sapiens
ucguggagaccaggccugcagggga

SEQ ID NO: 1170 - RNA, 25 nt, Homo sapiens
ugcaggggauggaaccuuccagaag

SEQ ID NO: 1171 - RNA, 25 nt, Homo sapiens
gcaggggauggaaccuuccagaagu

SEQ ID NO: 1172 - RNA, 25 nt, Homo sapiens
ggggauggaaccuuccagaaguggg

SEQ ID NO: 1173 - RNA, 25 nt, Homo sapiens
ggaaccuuccagaagugggcggcug

SEQ ID NO: 1174 - RNA, 25 nt, Homo sapiens
accuuccagaagugggcggcugugg

SEQ ID NO: 1175 - RNA, 25 nt, Homo sapiens
agugggcggcugugguggugccuuc

SEQ ID NO: 1176 - RNA, 25 nt, Homo sapiens
gcggcugugguggugccuucuggag

SEQ ID NO: 1177 - RNA, 25 nt, Homo sapiens
agauacaccugccaugugcagcaug

SEQ ID NO: 1178 - RNA, 25 nt, Homo sapiens
gauacaccugccaugugcagcauga

SEQ ID NO: 1179 - RNA, 25 nt, Homo sapiens
ucugcccaagccccucacccugaga

SEQ ID NO: 1180 - RNA, 25 nt, Homo sapiens
cugcccaagccccucacccugagau

SEQ ID NO: 1181 - RNA, 25 nt, Homo sapiens
ugcccaagccccucacccugagaug

SEQ ID NO: 1182 - RNA, 25 nt, Homo sapiens
aagccccucacccugagauggggua

SEQ ID NO: 1183 - RNA, 25 nt, Homo sapiens
ccccucacccugagaugggguaagg

SEQ ID NO: 1184 - RNA, 25 nt, Homo sapiens
cccucacccugagaugggguaagga

SEQ ID NO: 1185 - RNA, 25 nt, Homo sapiens
cccugagaugggguaaggagggaga

SEQ ID NO: 1186 - RNA, 25 nt, Homo sapiens
ccugagaugggguaaggagggagau

SEQ ID NO: 1187 - RNA, 25 nt, Homo sapiens
cugagaugggguaaggagggagaug

SEQ ID NO: 1188 - RNA, 25 nt, Homo sapiens
ugagaugggguaaggagggagaugg

SEQ ID NO: 1189 - RNA, 25 nt, Homo sapiens
cauaugugucuugggggggucugac

SEQ ID NO: 1190 - RNA, 25 nt, Homo sapiens
ucauaugugucuugggggggucuga

SEQ ID NO: 1191 - RNA, 25 nt, Homo sapiens
guggugggucauaugugucuugggg

SEQ ID NO: 1192 - RNA, 25 nt, Homo sapiens
gguggugggucauaugugucuuggg

SEQ ID NO: 1193 - RNA, 25 nt, Homo sapiens
ggguggugggucauaugugucuugg

SEQ ID NO: 1194 - RNA, 25 nt, Homo sapiens
gggguggugggucauaugugucuug

SEQ ID NO: 1195 - RNA, 25 nt, Homo sapiens
ugggguggugggucauaugugucuu

SEQ ID NO: 1196 - RNA, 25 nt, Homo sapiens
augggguggugggucauaugugucu

SEQ ID NO: 1197 - RNA, 25 nt, Homo sapiens
gccucauggucagagaugggguggu

SEQ ID NO: 1198 - RNA, 25 nt, Homo sapiens
ggccucauggucagagauggggugg

SEQ ID NO: 1199 - RNA, 25 nt, Homo sapiens
gguggccucauggucagagaugggg

SEQ ID NO: 1200 - RNA, 25 nt, Homo sapiens
caggguggccucauggucagagaug

SEQ ID NO: 1201 - RNA, 25 nt, Homo sapiens
ucaggguggccucauggucagagau

SEQ ID NO: 1202 - RNA, 25 nt, Homo sapiens
cucaggguggccucauggucagaga

SEQ ID NO: 1203 - RNA, 25 nt, Homo sapiens
ggcccagcaccucaggguggccuca

SEQ ID NO: 1204 - RNA, 25 nt, Homo sapiens
aagcccagggcccagcaccucaggg

SEQ ID NO: 1205 - RNA, 25 nt, Homo sapiens
uagaagcccagggcccagcaccuca

SEQ ID NO: 1206 - RNA, 25 nt, Homo sapiens
guagaagcccagggcccagcaccuc

SEQ ID NO: 1207 - RNA, 25 nt, Homo sapiens
gugaucuccgcaggguagaagccca

SEQ ID NO: 1208 - RNA, 25 nt, Homo sapiens
ugugaucuccgcaggguagaagccc

SEQ ID NO: 1209 - RNA, 25 nt, Homo sapiens
cugccaggucagugugaucuccgca

SEQ ID NO: 1210 - RNA, 25 nt, Homo sapiens
gcugccaggucagugugaucuccgc

SEQ ID NO: 1211 - RNA, 25 nt, Homo sapiens
gucugguccuccccaucccgcugcc

SEQ ID NO: 1212 - RNA, 25 nt, Homo sapiens
cuccacgagcuccguguccuggguc

SEQ ID NO: 1213 - RNA, 25 nt, Homo sapiens
cuggucuccacgagcuccguguccu

SEQ ID NO: 1214 - RNA, 25 nt, Homo sapiens
ccuggucuccacgagcuccgugucc

SEQ ID NO: 1215 - RNA, 25 nt, Homo sapiens
uggaagguuccauccccugcaggcc

SEQ ID NO: 1216 - RNA, 25 nt, Homo sapiens
acuucuggaagguuccauccccugc

SEQ ID NO: 1217 - RNA, 25 nt, Homo sapiens
accaccacagccgcccacuucugga

SEQ ID NO: 1218 - RNA, 25 nt, Homo sapiens
aggcaccaccacagccgcccacuuc

SEQ ID NO: 1219 - RNA, 25 nt, Homo sapiens
agguguaucucugcuccucuccaga

SEQ ID NO: 1220 - RNA, 25 nt, Homo sapiens
ggcagacccucaugcugcacauggc

SEQ ID NO: 1221 - RNA, 25 nt, Homo sapiens
cuugggcagacccucaugcugcaca

SEQ ID NO: 1222 - RNA, 25 nt, Homo sapiens
uaccccaucucagggugaggggcuu

SEQ ID NO: 1223 - RNA, 25 nt, Homo sapiens
uuaccccaucucagggugaggggcu

SEQ ID NO: 1224 - RNA, 25 nt, Homo sapiens
ccuccuuaccccaucucagggugag

SEQ ID NO: 1225 - RNA, 25 nt, Homo sapiens
cccuccuuaccccaucucaggguga

SEQ ID NO: 1226 - RNA, 25 nt, Homo sapiens
ucccuccuuaccccaucucagggug

SEQ ID NO: 1227 - RNA, 25 nt, Homo sapiens
ccaucucccuccuuaccccaucuca

SEQ ID NO: 1228 - RNA, 25 nt, Homo sapiens
cccaucucccuccuuaccccaucuc

SEQ ID NO: 1229 - RNA, 25 nt, Homo sapiens
ucuucccagcccaccauccccaucg

SEQ ID NO: 1230 - RNA, 25 nt, Homo sapiens
cuucccagcccaccauccccaucgu

SEQ ID NO: 1231 - RNA, 25 nt, Homo sapiens
ccauccccaucgugggcaucauugc

SEQ ID NO: 1232 - RNA, 25 nt, Homo sapiens
cccaucgugggcaucauugcuggcc

SEQ ID NO: 1233 - RNA, 25 nt, Homo sapiens
gcaucauugcuggccugguucuccu

SEQ ID NO: 1234 - RNA, 25 nt, Homo sapiens
ugguucuccuuggagcugugaucac

SEQ ID NO: 1235 - RNA, 25 nt, Homo sapiens
cuuggagcugugaucacuggagcug

SEQ ID NO: 1236 - RNA, 25 nt, Homo sapiens
uggagcuguggucgcugccgugaug

SEQ ID NO: 1237 - RNA, 25 nt, Homo sapiens
agcuguggucgcugccgugaugugg

SEQ ID NO: 1238 - RNA, 25 nt, Homo sapiens
uguggucgcugccgugauguggagg

SEQ ID NO: 1239 - RNA, 25 nt, Homo sapiens
ccgugauguggaggaggaagagcuc

SEQ ID NO: 1240 - RNA, 25 nt, Homo sapiens
ugauguggaggaggaagagcucagg

SEQ ID NO: 1241 - RNA, 25 nt, Homo sapiens
ggaggaggaagagcucagguggaga

SEQ ID NO: 1242 - RNA, 25 nt, Homo sapiens
gaggaggaagagcucagguggagaa

SEQ ID NO: 1243 - RNA, 25 nt, Homo sapiens
aggaggaagagcucagguggagaag

SEQ ID NO: 1244 - RNA, 25 nt, Homo sapiens
aagagcucagguggagaagggguga

SEQ ID NO: 1245 - RNA, 25 nt, Homo sapiens
agagcucagguggagaaggggugaa

SEQ ID NO: 1246 - RNA, 25 nt, Homo sapiens
gcucagguggagaaggggugaaggg

SEQ ID NO: 1247 - RNA, 25 nt, Homo sapiens
cucagguggagaaggggugaagggu

SEQ ID NO: 1248 - RNA, 25 nt, Homo sapiens
ucagguggagaaggggugaagggug

SEQ ID NO: 1249 - RNA, 25 nt, Homo sapiens
gcucugggaaaagaggggaagguga

SEQ ID NO: 1250 - RNA, 25 nt, Homo sapiens
agcucugggaaaagaggggaaggug

SEQ ID NO: 1251 - RNA, 25 nt, Homo sapiens
aagacagcucugggaaaagagggga

SEQ ID NO: 1252 - RNA, 25 nt, Homo sapiens
ugggaagacagcucugggaaaagag

SEQ ID NO: 1253 - RNA, 25 nt, Homo sapiens
cugggaagacagcucugggaaaaga

SEQ ID NO: 1254 - RNA, 25 nt, Homo sapiens
gcugggaagacagcucugggaaaag

SEQ ID NO: 1255 - RNA, 25 nt, Homo sapiens
gauggugggcugggaagacagcucu

SEQ ID NO: 1256 - RNA, 25 nt, Homo sapiens
ggauggugggcugggaagacagcuc

SEQ ID NO: 1257 - RNA, 25 nt, Homo sapiens
augcccacgauggggauggugggcu

SEQ ID NO: 1258 - RNA, 25 nt, Homo sapiens
gaugcccacgauggggauggugggc

SEQ ID NO: 1259 - RNA, 25 nt, Homo sapiens
caaugaugcccacgauggggauggu

SEQ ID NO: 1260 - RNA, 25 nt, Homo sapiens
gcaaugaugcccacgauggggaugg

SEQ ID NO: 1261 - RNA, 25 nt, Homo sapiens
ccagcaaugaugcccacgaugggga

SEQ ID NO: 1262 - RNA, 25 nt, Homo sapiens
caggccagcaaugaugcccacgaug

SEQ ID NO: 1263 - RNA, 25 nt, Homo sapiens
ccaggccagcaaugaugcccacgau

SEQ ID NO: 1264 - RNA, 25 nt, Homo sapiens
accaggccagcaaugaugcccacga

SEQ ID NO: 1265 - RNA, 25 nt, Homo sapiens
agugaucacagcuccaaggagaacc

SEQ ID NO: 1266 - RNA, 25 nt, Homo sapiens
cacagcuccagugaucacagcucca

SEQ ID NO: 1267 - RNA, 25 nt, Homo sapiens
ccugagcucuuccuccuccacauca

SEQ ID NO: 1268 - RNA, 25 nt, Homo sapiens
gacauuuucuucucacagauagaaa

SEQ ID NO: 1269 - RNA, 25 nt, Homo sapiens
auuuucuucucacagauagaaaagg

SEQ ID NO: 1270 - RNA, 25 nt, Homo sapiens
uuuucuucucacagauagaaaagga

SEQ ID NO: 1271 - RNA, 25 nt, Homo sapiens
gauagaaaaggagggaguuacacuc

SEQ ID NO: 1272 - RNA, 25 nt, Homo sapiens
acacucaggcugcaaguaaguauga

SEQ ID NO: 1273 - RNA, 25 nt, Homo sapiens
cucaggcugcaaguaaguaugaagg

SEQ ID NO: 1274 - RNA, 25 nt, Homo sapiens
ucuaccccaggcagugacagugccc

SEQ ID NO: 1275 - RNA, 25 nt, Homo sapiens
cuaccccaggcagugacagugccca

SEQ ID NO: 1276 - RNA, 25 nt, Homo sapiens
cugaugugucccucacagcuuguaa

SEQ ID NO: 1277 - RNA, 25 nt, Homo sapiens
cucacagcuuguaaaggugagagcu

SEQ ID NO: 1278 - RNA, 25 nt, Homo sapiens
acagcuuguaaaggugagagcuugg

SEQ ID NO: 1279 - RNA, 25 nt, Homo sapiens
gagcccugggcacugucacugccug

SEQ ID NO: 1280 - RNA, 25 nt, Homo sapiens
agagcccugggcacugucacugccu

SEQ ID NO: 1281 - RNA, 25 nt, Homo sapiens
cagagcccugggcacugucacugcc

SEQ ID NO: 1282 - RNA, 25 nt, Homo sapiens
gcugugagggacacaucagagcccu

SEQ ID NO: 1283 - RNA, 25 nt, Homo sapiens
agcugugagggacacaucagagccc

SEQ ID NO: 1284 - RNA, 25 nt, Homo sapiens
aagcucucaccuuuacaagcuguga

SEQ ID NO: 1285 - RNA, 25 nt, Homo sapiens
caagcucucaccuuuacaagcugug

SEQ ID NO: 1286 - RNA, 25 nt, Homo sapiens
uauagugugagacagcugccuugug

SEQ ID NO: 1287 - RNA, 25 nt, Homo sapiens
auagugugagacagcugccuugugu

SEQ ID NO: 1288 - RNA, 25 nt, Homo sapiens
gacagcugccuugugugggacugag

SEQ ID NO: 1289 - RNA, 25 nt, Homo sapiens
aagaacccugacuuuguuucugcaa

SEQ ID NO: 1290 - RNA, 25 nt, Homo sapiens
caccugcaugugucuguguucgugu

SEQ ID NO: 1291 - RNA, 25 nt, Homo sapiens
ucuguguucguguaggcauaaugug

SEQ ID NO: 1292 - RNA, 25 nt, Homo sapiens
guguucguguaggcauaaugugagg

SEQ ID NO: 1293 - RNA, 25 nt, Homo sapiens
uucguguaggcauaaugugaggagg

SEQ ID NO: 1294 - RNA, 25 nt, Homo sapiens
ucguguaggcauaaugugaggaggu

SEQ ID NO: 1295 - RNA, 25 nt, Homo sapiens
cguguaggcauaaugugaggaggug

SEQ ID NO: 1296 - RNA, 25 nt, Homo sapiens
cccaaucaucuuuccuguuccagag

SEQ ID NO: 1297 - RNA, 25 nt, Homo sapiens
aaucaucuuuccuguuccagagagg

SEQ ID NO: 1298 - RNA, 25 nt, Homo sapiens
aucaucuuuccuguuccagagaggu

SEQ ID NO: 1299 - RNA, 25 nt, Homo sapiens
ucaucuuuccuguuccagagaggug

SEQ ID NO: 1300 - RNA, 25 nt, Homo sapiens
uuccuguuccagagagguggggcug

SEQ ID NO: 1301 - RNA, 25 nt, Homo sapiens
ugucuccaucucugucucaacuuca

SEQ ID NO: 1302 - RNA, 25 nt, Homo sapiens
uacuuucucaaauucuugccaugag

SEQ ID NO: 1303 - RNA, 25 nt, Homo sapiens
caugagagguugaugaguuaauuaa

SEQ ID NO: 1304 - RNA, 25 nt, Homo sapiens
ccuaaaauuugagagacaaaauaaa

SEQ ID NO: 1305 - RNA, 25 nt, Homo sapiens
aacucuugccucucagucccacaca

SEQ ID NO: 1306 - RNA, 25 nt, Homo sapiens
uucuucaagucacaaagggaagggc

SEQ ID NO: 1307 - RNA, 25 nt, Homo sapiens
aggguucuucaagucacaaagggaa

SEQ ID NO: 1308 - RNA, 25 nt, Homo sapiens
caggguucuucaagucacaaaggga

SEQ ID NO: 1309 - RNA, 25 nt, Homo sapiens
aagucaggguucuucaagucacaaa

SEQ ID NO: 1310 - RNA, 25 nt, Homo sapiens
aaagucaggguucuucaagucacaa

SEQ ID NO: 1311 - RNA, 25 nt, Homo sapiens
aggugccuuugcagaaacaaaguca

SEQ ID NO: 1312 - RNA, 25 nt, Homo sapiens
caggugccuuugcagaaacaaaguc

SEQ ID NO: 1313 - RNA, 25 nt, Homo sapiens
ugccuacacgaacacagacacaugc

SEQ ID NO: 1314 - RNA, 25 nt, Homo sapiens
ggucaugguggacaugggggugggg

SEQ ID NO: 1315 - RNA, 25 nt, Homo sapiens
gagggucaugguggacaugggggug

SEQ ID NO: 1316 - RNA, 25 nt, Homo sapiens
agagggucaugguggacaugggggu

SEQ ID NO: 1317 - RNA, 25 nt, Homo sapiens
aagagggucaugguggacauggggg

SEQ ID NO: 1318 - RNA, 25 nt, Homo sapiens
gggaagagggucaugguggacaugg

SEQ ID NO: 1319 - RNA, 25 nt, Homo sapiens
ugggaagagggucaugguggacaug

SEQ ID NO: 1320 - RNA, 25 nt, Homo sapiens
gugggaagagggucaugguggacau

SEQ ID NO: 1321 - RNA, 25 nt, Homo sapiens
cgugggaagagggucaugguggaca

SEQ ID NO: 1322 - RNA, 25 nt, Homo sapiens
ggucagcgugggaagagggucaugg

SEQ ID NO: 1323 - RNA, 25 nt, Homo sapiens
acaggucagcgugggaagaggguca

SEQ ID NO: 1324 - RNA, 25 nt, Homo sapiens
gggagcacaggucagcgugggaaga

SEQ ID NO: 1325 - RNA, 25 nt, Homo sapiens
agggagcacaggucagcgugggaag

SEQ ID NO: 1326 - RNA, 25 nt, Homo sapiens
uuggggagggagcacaggucagcgu

SEQ ID NO: 1327 - RNA, 25 nt, Homo sapiens
auuggggagggagcacaggucagcg

SEQ ID NO: 1328 - RNA, 25 nt, Homo sapiens
ggaaagaugauuggggagggagcac

SEQ ID NO: 1329 - RNA, 25 nt, Homo sapiens
cuggaacaggaaagaugauugggga

SEQ ID NO: 1330 - RNA, 25 nt, Homo sapiens
ucuggaacaggaaagaugauugggg

SEQ ID NO: 1331 - RNA, 25 nt, Homo sapiens
cucucuggaacaggaaagaugauug

SEQ ID NO: 1332 - RNA, 25 nt, Homo sapiens
ccucucuggaacaggaaagaugauu

SEQ ID NO: 1333 - RNA, 25 nt, Homo sapiens
accucucuggaacaggaaagaugau

SEQ ID NO: 1334 - RNA, 25 nt, Homo sapiens
caccucagccccaccucucuggaac

SEQ ID NO: 1335 - RNA, 25 nt, Homo sapiens
uggagacaccucagccccaccucuc

SEQ ID NO: 1336 - RNA, 25 nt, Homo sapiens
gugcaccaugaaguugagacagaga

SEQ ID NO: 1337 - RNA, 25 nt, Homo sapiens
acuaagguucuaauuuuaauaggga

SEQ ID NO: 1338 - RNA, 25 nt, Homo sapiens
uuauacuaagguucuaauuuuaaua

SEQ ID NO: 1339 - RNA, 25 nt, Homo sapiens
uuuauacuaagguucuaauuuuaau

SEQ ID NO: 1340 - RNA, 25 nt, Homo sapiens
aauuugagaaaguaaauuuauacua

SEQ ID NO: 1341 - RNA, 25 nt, Homo sapiens
cuuuaauuaacucaucaaccucuca

SEQ ID NO: 1342 - RNA, 25 nt, Homo sapiens
ccauuuauuuugucucucaaauuuu

SEQ ID NO: 1343 - RNA, 25 nt, Homo sapiens
gcacaagaaacacguggacucugga

SEQ ID NO: 1344 - RNA, 25 nt, Homo sapiens
aucagcacaagaaacacguggacuc

SEQ ID NO: 1345 - RNA, 25 nt, Homo sapiens
gcaacaaaucagcacaagaaacacg

SEQ ID NO: 1346 - RNA, 25 nt, Homo sapiens
cucagcacagcgaacaugcagauuc

SEQ ID NO: 1347 - RNA, 25 nt, Homo sapiens
gcacagcgaacaugcagauucugga

SEQ ID NO: 1348 - RNA, 25 nt, Homo sapiens
aacaugcagauucuggaagguucuc

SEQ ID NO: 1349 - RNA, 25 nt, Homo sapiens
gucuuuauuugcucucucaaauucc

SEQ ID NO: 1350 - RNA, 25 nt, Homo sapiens
uuauauucagauucuuauuuucagu

SEQ ID NO: 1351 - RNA, 25 nt, Homo sapiens
uauauucagauucuuauuuucagua

SEQ ID NO: 1352 - RNA, 25 nt, Homo sapiens
agugcacguaaaguugagacagaga

SEQ ID NO: 1353 - RNA, 25 nt, Homo sapiens
auggagacauccagccccaccucuc

SEQ ID NO: 1354 - RNA, 25 nt, Homo sapiens
accucucuggaacaagaaagaugac

SEQ ID NO: 1355 - RNA, 25 nt, Homo sapiens
ccucucuggaacaagaaagaugacu

SEQ ID NO: 1356 - RNA, 25 nt, Homo sapiens
cucucuggaacaagaaagaugacug

SEQ ID NO: 1357 - RNA, 25 nt, Homo sapiens
ucuggaacaagaaagaugacugggg

SEQ ID NO: 1358 - RNA, 25 nt, Homo sapiens
agaaagaugacuggggaggaaacac

SEQ ID NO: 1359 - RNA, 25 nt, Homo sapiens
acuggggaggaaacacaggucagca

SEQ ID NO: 1360 - RNA, 25 nt, Homo sapiens
cuggggaggaaacacaggucagcau

SEQ ID NO: 1361 - RNA, 25 nt, Homo sapiens
aggaaacacaggucagcaugggaac

SEQ ID NO: 1362 - RNA, 25 nt, Homo sapiens
ggaaacacaggucagcaugggaaca

SEQ ID NO: 1363 - RNA, 25 nt, Homo sapiens
gaaacacaggucagcaugggaacag

SEQ ID NO: 1364 - RNA, 25 nt, Homo sapiens
gucagcaugggaacaggggucacag

SEQ ID NO: 1365 - RNA, 25 nt, Homo sapiens
gggaacaggggucacaguggacaca

SEQ ID NO: 1366 - RNA, 25 nt, Homo sapiens
ggaacaggggucacaguggacacaa

SEQ ID NO: 1367 - RNA, 25 nt, Homo sapiens
acaggggucacaguggacacaaggg

SEQ ID NO: 1368 - RNA, 25 nt, Homo sapiens
caggggucacaguggacacaagggu

SEQ ID NO: 1369 - RNA, 25 nt, Homo sapiens
cuccaccuccucacauuaugcuaac

SEQ ID NO: 1370 - RNA, 25 nt, Homo sapiens
uccaccuccucacauuaugcuaaca

SEQ ID NO: 1371 - RNA, 25 nt, Homo sapiens
ugcuaacagggacgcagacacauuc

SEQ ID NO: 1372 - RNA, 25 nt, Homo sapiens
gugccuuugcagaaagagaugccag

SEQ ID NO: 1373 - RNA, 25 nt, Homo sapiens
augccagaggcucuugaagucacaa

SEQ ID NO: 1374 - RNA, 25 nt, Homo sapiens
ugccagaggcucuugaagucacaaa

SEQ ID NO: 1375 - RNA, 25 nt, Homo sapiens
gccagaggcucuugaagucacaaag

SEQ ID NO: 1376 - RNA, 25 nt, Homo sapiens
agaggcucuugaagucacaaagggg

SEQ ID NO: 1377 - RNA, 25 nt, Homo sapiens
cagucccucacaagacagcugucuc

SEQ ID NO: 1378 - RNA, 25 nt, Homo sapiens
uggauuaauuaaauaagucaauucc

SEQ ID NO: 1379 - RNA, 25 nt, Homo sapiens
ucaaauauuugcuaugagagguuga

SEQ ID NO: 1380 - RNA, 25 nt, Homo sapiens
uguuuucucaaauauuugcuaugag

SEQ ID NO: 1381 - RNA, 25 nt, Homo sapiens
cuuucuuguuccagagagguggggc

SEQ ID NO: 1382 - RNA, 25 nt, Homo sapiens
ucaucuuucuuguuccagagaggug

SEQ ID NO: 1383 - RNA, 25 nt, Homo sapiens
gucaucuuucuuguuccagagaggu

SEQ ID NO: 1384 - RNA, 25 nt, Homo sapiens
agucaucuuucuuguuccagagagg

SEQ ID NO: 1385 - RNA, 25 nt, Homo sapiens
cccagucaucuuucuuguuccagag

SEQ ID NO: 1386 - RNA, 25 nt, Homo sapiens
ucccuguuagcauaaugugaggagg

SEQ ID NO: 1387 - RNA, 25 nt, Homo sapiens
gcgucccuguuagcauaaugugagg

SEQ ID NO: 1388 - RNA, 25 nt, Homo sapiens
ucugcgucccuguuagcauaaugug

SEQ ID NO: 1389 - RNA, 25 nt, Homo sapiens
gagccucuggcaucucuuucugcaa

SEQ ID NO: 1390 - RNA, 25 nt, Homo sapiens
uccccuuugugacuucaagagccuc

SEQ ID NO: 1391 - RNA, 25 nt, Homo sapiens
gcugucuugugagggacugagaugc

SEQ ID NO: 1392 - RNA, 25 nt, Homo sapiens
guagccugagacagcugucuuguga

SEQ ID NO: 1393 - RNA, 25 nt, Homo sapiens
uguagccugagacagcugucuugug

SEQ ID NO: 1394 - RNA, 25 nt, Homo sapiens
agcugugagagacacaucagagccc

SEQ ID NO: 1395 - RNA, 25 nt, Homo sapiens
gcugugagagacacaucagagcccu

SEQ ID NO: 1396 - RNA, 25 nt, Homo sapiens
cagagcccugggcacugucgcugcc

SEQ ID NO: 1397 - RNA, 25 nt, Homo sapiens
ucgcugccuggaguagaacaaaaac

SEQ ID NO: 1398 - RNA, 25 nt, Homo sapiens
acagcuugaaaaggugagauucuug

SEQ ID NO: 1399 - RNA, 25 nt, Homo sapiens
cacagcuugaaaaggugagauucuu

SEQ ID NO: 1400 - RNA, 25 nt, Homo sapiens
ucacagcuugaaaaggugagauucu

SEQ ID NO: 1401 - RNA, 25 nt, Homo sapiens
cugaugugucucucacagcuugaaa

SEQ ID NO: 1402 - RNA, 25 nt, Homo sapiens
cuacuccaggcagcgacagugccca

SEQ ID NO: 1403 - RNA, 25 nt, Homo sapiens
ucuacuccaggcagcgacagugccc

SEQ ID NO: 1404 - RNA, 25 nt, Homo sapiens
gaguagcucccuccuuuuccaccug

SEQ ID NO: 1405 - RNA, 25 nt, Homo sapiens
aguagcucccuccuuuuccaccugu

SEQ ID NO: 1406 - RNA, 25 nt, Homo sapiens
cguguaaguggugggggugggagug

SEQ ID NO: 1407 - RNA, 25 nt, Homo sapiens
caggcugcguguaaguggugggggu

SEQ ID NO: 1408 - RNA, 25 nt, Homo sapiens
ucaggcugcguguaagugguggggg

SEQ ID NO: 1409 - RNA, 25 nt, Homo sapiens
cucucaggcugcguguaaguggugg

SEQ ID NO: 1410 - RNA, 25 nt, Homo sapiens
acucucaggcugcguguaaguggug

SEQ ID NO: 1411 - RNA, 25 nt, Homo sapiens
uacucucaggcugcguguaaguggu

SEQ ID NO: 1412 - RNA, 25 nt, Homo sapiens
cuacucucaggcugcguguaagugg

SEQ ID NO: 1413 - RNA, 25 nt, Homo sapiens
gagcuacucucaggcugcguguaag

SEQ ID NO: 1414 - RNA, 25 nt, Homo sapiens
gguggaaaaggagggagcuacucuc

SEQ ID NO: 1415 - RNA, 25 nt, Homo sapiens
uuuucuucccacagguggaaaagga

SEQ ID NO: 1416 - RNA, 25 nt, Homo sapiens
auuuucuucccacagguggaaaagg

SEQ ID NO: 1417 - RNA, 25 nt, Homo sapiens
gacauuuucuucccacagguggaaa

SEQ ID NO: 1418 - RNA, 25 nt, Homo sapiens
ucacaggacauuuucuucccacagg

SEQ ID NO: 1419 - RNA, 25 nt, Homo sapiens
cacagcuccgaugaccacaacugcu

SEQ ID NO: 1420 - RNA, 25 nt, Homo sapiens
gaugaccacaacugcuaggacagcc

SEQ ID NO: 1421 - RNA, 25 nt, Homo sapiens
gccaggccagcaacaaugcccacga

SEQ ID NO: 1422 - RNA, 25 nt, Homo sapiens
ccaggccagcaacaaugcccacgau

SEQ ID NO: 1423 - RNA, 25 nt, Homo sapiens
caggccagcaacaaugcccacgaug

SEQ ID NO: 1424 - RNA, 25 nt, Homo sapiens
ccagcaacaaugcccacgaugggga

SEQ ID NO: 1425 - RNA, 25 nt, Homo sapiens
gcaacaaugcccacgauggggacgg

SEQ ID NO: 1426 - RNA, 25 nt, Homo sapiens
aaugcccacgauggggacgguggac

SEQ ID NO: 1427 - RNA, 25 nt, Homo sapiens
augcccacgauggggacgguggacu

SEQ ID NO: 1428 - RNA, 25 nt, Homo sapiens
cgauggggacgguggacugggaaga

SEQ ID NO: 1429 - RNA, 25 nt, Homo sapiens
ggacgguggacugggaagacggcuc

SEQ ID NO: 1430 - RNA, 25 nt, Homo sapiens
gacgguggacugggaagacggcucu

SEQ ID NO: 1431 - RNA, 25 nt, Homo sapiens
uggacugggaagacggcucugggaa

SEQ ID NO: 1432 - RNA, 25 nt, Homo sapiens
acugggaagacggcucugggaaagg

SEQ ID NO: 1433 - RNA, 25 nt, Homo sapiens
cugggaagacggcucugggaaagga

SEQ ID NO: 1434 - RNA, 25 nt, Homo sapiens
ugggaagacggcucugggaaaggag

SEQ ID NO: 1435 - RNA, 25 nt, Homo sapiens
ggcucugggaaaggaggggaagaug

SEQ ID NO: 1436 - RNA, 25 nt, Homo sapiens
gcucugggaaaggaggggaagauga

SEQ ID NO: 1437 - RNA, 25 nt, Homo sapiens
ucagguagggaaggggugaggggug

SEQ ID NO: 1438 - RNA, 25 nt, Homo sapiens
uucagguagggaaggggugaggggu

SEQ ID NO: 1439 - RNA, 25 nt, Homo sapiens
guucagguagggaaggggugagggg

SEQ ID NO: 1440 - RNA, 25 nt, Homo sapiens
agaguucagguagggaaggggugag

SEQ ID NO: 1441 - RNA, 25 nt, Homo sapiens
aagaguucagguagggaagggguga

SEQ ID NO: 1442 - RNA, 25 nt, Homo sapiens
gaagaguucagguagggaaggggug

SEQ ID NO: 1443 - RNA, 25 nt, Homo sapiens
aggaggaagaguucagguagggaag

SEQ ID NO: 1444 - RNA, 25 nt, Homo sapiens
uaggaggaagaguucagguagggaa

SEQ ID NO: 1445 - RNA, 25 nt, Homo sapiens
guaggaggaagaguucagguaggga

SEQ ID NO: 1446 - RNA, 25 nt, Homo sapiens
auguguaggaggaagaguucaggua

SEQ ID NO: 1447 - RNA, 25 nt, Homo sapiens
gauguguaggaggaagaguucaggu

SEQ ID NO: 1448 - RNA, 25 nt, Homo sapiens
cugugauguguaggaggaagaguuc

SEQ ID NO: 1449 - RNA, 25 nt, Homo sapiens
uguggucgcugcugugauguguagg

SEQ ID NO: 1450 - RNA, 25 nt, Homo sapiens
agcuguggucgcugcugugaugugu

SEQ ID NO: 1451 - RNA, 25 nt, Homo sapiens
cuagcaguuguggucaucggagcug

SEQ ID NO: 1452 - RNA, 25 nt, Homo sapiens
uggcuguccuagcaguuguggucau

SEQ ID NO: 1453 - RNA, 25 nt, Homo sapiens
gcuggccuggcuguccuagcaguug

SEQ ID NO: 1454 - RNA, 25 nt, Homo sapiens
cccaucgugggcauuguugcuggcc

SEQ ID NO: 1455 - RNA, 25 nt, Homo sapiens
ccguccccaucgugggcauuguugc

SEQ ID NO: 1456 - RNA, 25 nt, Homo sapiens
cuucccaguccaccguccccaucgu

SEQ ID NO: 1457 - RNA, 25 nt, Homo sapiens
ucuucccaguccaccguccccaucg

SEQ ID NO: 1458 - RNA, 25 nt, Homo sapiens
cucaucccccuccuuaccccaucuc

SEQ ID NO: 1459 - RNA, 25 nt, Homo sapiens
ucaucccccuccuuaccccaucuca

SEQ ID NO: 1460 - RNA, 25 nt, Homo sapiens
ccccuccuuaccccaucucagggug

SEQ ID NO: 1461 - RNA, 25 nt, Homo sapiens
cccuccuuaccccaucucaggguga

SEQ ID NO: 1462 - RNA, 25 nt, Homo sapiens
ccuccuuaccccaucucagggugag

SEQ ID NO: 1463 - RNA, 25 nt, Homo sapiens
uaccccaucucagggugaggggcuu

SEQ ID NO: 1464 - RNA, 25 nt, Homo sapiens
cuucggcagccccucaugcuguaca

SEQ ID NO: 1465 - RNA, 25 nt, Homo sapiens
auguguaucucugcucuucuccaga

SEQ ID NO: 1466 - RNA, 25 nt, Homo sapiens
aggcaccaccacagcugcccacuuc

SEQ ID NO: 1467 - RNA, 25 nt, Homo sapiens
accaccacagcugcccacuucugga

SEQ ID NO: 1468 - RNA, 25 nt, Homo sapiens
acuucuggaagguucuaucuccugc

SEQ ID NO: 1469 - RNA, 25 nt, Homo sapiens
uggaagguucuaucuccugcugguc

SEQ ID NO: 1470 - RNA, 25 nt, Homo sapiens
cuccacaagcucaguguccugaguu

SEQ ID NO: 1471 - RNA, 25 nt, Homo sapiens
guuugguccucgccaucccgcugcc

SEQ ID NO: 1472 - RNA, 25 nt, Homo sapiens
gcugccaggucagugugaucuccgc

SEQ ID NO: 1473 - RNA, 25 nt, Homo sapiens
cugccaggucagugugaucuccgca

SEQ ID NO: 1474 - RNA, 25 nt, Homo sapiens
ugugaucuccgcaggguagaaaccc

SEQ ID NO: 1475 - RNA, 25 nt, Homo sapiens
gugaucuccgcaggguagaaaccca

SEQ ID NO: 1476 - RNA, 25 nt, Homo sapiens
guagaaacccagggcccagcaccuc

SEQ ID NO: 1477 - RNA, 25 nt, Homo sapiens
uagaaacccagggcccagcaccuca

SEQ ID NO: 1478 - RNA, 25 nt, Homo sapiens
aaacccagggcccagcaccucaggg

SEQ ID NO: 1479 - RNA, 25 nt, Homo sapiens
ggcccagcaccucaggguggccuca

SEQ ID NO: 1480 - RNA, 25 nt, Homo sapiens
cucaggguggccucauggucagaga

SEQ ID NO: 1481 - RNA, 25 nt, Homo sapiens
ucaggguggccucauggucagagau

SEQ ID NO: 1482 - RNA, 25 nt, Homo sapiens
caggguggccucauggucagagaug

SEQ ID NO: 1483 - RNA, 25 nt, Homo sapiens
gguggccucauggucagagaugggg

SEQ ID NO: 1484 - RNA, 25 nt, Homo sapiens
ggccucauggucagagauggggugg

SEQ ID NO: 1485 - RNA, 25 nt, Homo sapiens
gccucauggucagagaugggguggu

SEQ ID NO: 1486 - RNA, 25 nt, Homo sapiens
ugggguggugggucacgugugucuu

SEQ ID NO: 1487 - RNA, 25 nt, Homo sapiens
gggguggugggucacgugugucuuu

SEQ ID NO: 1488 - RNA, 25 nt, Homo sapiens
ggguggugggucacgugugucuuug

SEQ ID NO: 1489 - RNA, 25 nt, Homo sapiens
gguggugggucacgugugucuuugg

SEQ ID NO: 1490 - RNA, 25 nt, Homo sapiens
guggugggucacgugugucuuuggg

SEQ ID NO: 1491 - RNA, 25 nt, Homo sapiens
ucacgugugucuuuggggggucuga

SEQ ID NO: 1492 - RNA, 25 nt, Homo sapiens
cacgugugucuuuggggggucugau

SEQ ID NO: 1493 - RNA, 25 nt, Homo sapiens
gagaugggguaaggagggggaugag

SEQ ID NO: 1494 - RNA, 25 nt, Homo sapiens
ugagaugggguaaggagggggauga

SEQ ID NO: 1495 - RNA, 25 nt, Homo sapiens
cugagaugggguaaggagggggaug

SEQ ID NO: 1496 - RNA, 25 nt, Homo sapiens
cucacccugagaugggguaaggagg

SEQ ID NO: 1497 - RNA, 25 nt, Homo sapiens
ccucacccugagaugggguaaggag

SEQ ID NO: 1498 - RNA, 25 nt, Homo sapiens
cccucacccugagaugggguaagga

SEQ ID NO: 1499 - RNA, 25 nt, Homo sapiens
ccccucacccugagaugggguaagg

SEQ ID NO: 1500 - RNA, 25 nt, Homo sapiens
aagccccucacccugagauggggua

SEQ ID NO: 1501 - RNA, 25 nt, Homo sapiens
ugccgaagccccucacccugagaug

SEQ ID NO: 1502 - RNA, 25 nt, Homo sapiens
cugccgaagccccucacccugagau

SEQ ID NO: 1503 - RNA, 25 nt, Homo sapiens
gcugccgaagccccucacccugaga

SEQ ID NO: 1504 - RNA, 25 nt, Homo sapiens
auacacaugccauguacagcaugag

SEQ ID NO: 1505 - RNA, 25 nt, Homo sapiens
gauacacaugccauguacagcauga

SEQ ID NO: 1506 - RNA, 25 nt, Homo sapiens
agauacacaugccauguacagcaug

SEQ ID NO: 1507 - RNA, 25 nt, Homo sapiens
agugggcagcugugguggugccuuc

SEQ ID NO: 1508 - RNA, 25 nt, Homo sapiens
accuuccagaagugggcagcugugg

SEQ ID NO: 1509 - RNA, 25 nt, Homo sapiens
agaaccuuccagaagugggcagcug

SEQ ID NO: 1510 - RNA, 25 nt, Homo sapiens
gcaggagauagaaccuuccagaagu

SEQ ID NO: 1511 - RNA, 25 nt, Homo sapiens
agcaggagauagaaccuuccagaag

SEQ ID NO: 1512 - RNA, 25 nt, Homo sapiens
cugagcuuguggagaccagaccagc

SEQ ID NO: 1513 - RNA, 25 nt, Homo sapiens
gaccaaacucaggacacugagcuug

SEQ ID NO: 1514 - RNA, 25 nt, Homo sapiens
cagcgggauggcgaggaccaaacuc

SEQ ID NO: 1515 - RNA, 25 nt, Homo sapiens
acacugaccuggcagcgggauggcg

SEQ ID NO: 1516 - RNA, 25 nt, Homo sapiens
agaucacacugaccuggcagcggga

SEQ ID NO: 1517 - RNA, 25 nt, Homo sapiens
gcggagaucacacugaccuggcagc

SEQ ID NO: 1518 - RNA, 25 nt, Homo sapiens
ugcggagaucacacugaccuggcag

SEQ ID NO: 1519 - RNA, 25 nt, Homo sapiens
cuacccugcggagaucacacugacc

SEQ ID NO: 1520 - RNA, 25 nt, Homo sapiens
ugcugggcccuggguuucuacccug

SEQ ID NO: 1521 - RNA, 25 nt, Homo sapiens
aggccacccugaggugcugggcccu

SEQ ID NO: 1522 - RNA, 25 nt, Homo sapiens
gaggccacccugaggugcugggccc

SEQ ID NO: 1523 - RNA, 25 nt, Homo sapiens
gaccaugaggccacccugaggugcu

SEQ ID NO: 1524 - RNA, 25 nt, Homo sapiens
ugaccaugaggccacccugaggugc

SEQ ID NO: 1525 - RNA, 25 nt, Homo sapiens
caucucugaccaugaggccacccug

SEQ ID NO: 1526 - RNA, 25 nt, Homo sapiens
acccaccaccccaucucugaccaug

SEQ ID NO: 1527 - RNA, 25 nt, Homo sapiens
cuccagcuuguccuucccguucucc

SEQ ID NO: 1528 - RNA, 25 nt, Homo sapiens
guccuucccguucuccagguaucug

SEQ ID NO: 1529 - RNA, 25 nt, Homo sapiens
gagccacuccacgcacucgcccucc

SEQ ID NO: 1530 - RNA, 25 nt, Homo sapiens
cacuccacgcacucgcccuccaggu

SEQ ID NO: 1531 - RNA, 25 nt, Homo sapiens
guaggcucuccgcugcuccgccuca

SEQ ID NO: 1532 - RNA, 25 nt, Homo sapiens
uaggcucuccgcugcuccgccucac

SEQ ID NO: 1533 - RNA, 25 nt, Homo sapiens
cucacgggccgccucccacuugcgc

SEQ ID NO: 1534 - RNA, 25 nt, Homo sapiens
ucacgggccgccucccacuugcgcu

SEQ ID NO: 1535 - RNA, 25 nt, Homo sapiens
ugggugaucugagccgccguguccg

SEQ ID NO: 1536 - RNA, 25 nt, Homo sapiens
gugaucugagccgccguguccgcgg

SEQ ID NO: 1537 - RNA, 25 nt, Homo sapiens
ugagccgccguguccgcggcggucc

SEQ ID NO: 1538 - RNA, 25 nt, Homo sapiens
cguguccgcggcgguccaggagcgc

SEQ ID NO: 1539 - RNA, 25 nt, Homo sapiens
gguccaggagcgcagguccucguuc

SEQ ID NO: 1540 - RNA, 25 nt, Homo sapiens
guccaggagcgcagguccucguuca

SEQ ID NO: 1541 - RNA, 25 nt, Homo sapiens
agggcgauguaauccuugccgucgu

SEQ ID NO: 1542 - RNA, 25 nt, Homo sapiens
guaauccuugccgucguaggcguac

SEQ ID NO: 1543 - RNA, 25 nt, Homo sapiens
gucguaggcguacuggucaugcccg

SEQ ID NO: 1544 - RNA, 25 nt, Homo sapiens
guaggcguacuggucaugcccgcgg

SEQ ID NO: 1545 - RNA, 25 nt, Homo sapiens
ggcguacuggucaugcccgcggagg

SEQ ID NO: 1546 - RNA, 25 nt, Homo sapiens
caugcccgcggaggaggcgcccguc

SEQ ID NO: 1547 - RNA, 25 nt, Homo sapiens
ccccacgucgcagccguacaugcuc

SEQ ID NO: 1548 - RNA, 25 nt, Homo sapiens
cacgucgcagccguacaugcucugg

SEQ ID NO: 1549 - RNA, 25 nt, Homo sapiens
acgucgcagccguacaugcucugga

SEQ ID NO: 1550 - RNA, 25 nt, Homo sapiens
gagcgcgcugguaccaggggcagug

SEQ ID NO: 1551 - RNA, 25 nt, Homo sapiens
ggagcgcgcugguaccaggggcagu

SEQ ID NO: 1552 - RNA, 25 nt, Homo sapiens
uggagcgcgcugguaccaggggcag

SEQ ID NO: 1553 - RNA, 25 nt, Homo sapiens
acaagcuggagcgcgcugguaccag

SEQ ID NO: 1554 - RNA, 25 nt, Homo sapiens
gacaagcuggagcgcgcugguacca

SEQ ID NO: 1555 - RNA, 25 nt, Homo sapiens
ggacaagcuggagcgcgcugguacc

SEQ ID NO: 1556 - RNA, 25 nt, Homo sapiens
acgggaaggacaagcuggagcgcgc

SEQ ID NO: 1557 - RNA, 25 nt, Homo sapiens
uaccuggagaacgggaaggacaagc

SEQ ID NO: 1558 - RNA, 25 nt, Homo sapiens
cuccgcagauaccuggagaacggga

SEQ ID NO: 1559 - RNA, 25 nt, Homo sapiens
guggcuccgcagauaccuggagaac

SEQ ID NO: 1560 - RNA, 25 nt, Homo sapiens
aguggcuccgcagauaccuggagaa

SEQ ID NO: 1561 - RNA, 25 nt, Homo sapiens
ugcguggaguggcuccgcagauacc

SEQ ID NO: 1562 - RNA, 25 nt, Homo sapiens
cuaccuggagggcgagugcguggag

SEQ ID NO: 1563 - RNA, 25 nt, Homo sapiens
agagccuaccuggagggcgagugcg

SEQ ID NO: 1564 - RNA, 25 nt, Homo sapiens
cggagcagcggagagccuaccugga

SEQ ID NO: 1565 - RNA, 25 nt, Homo sapiens
gcggagcagcggagagccuaccugg

SEQ ID NO: 1566 - RNA, 25 nt, Homo sapiens
gaggcggagcagcggagagccuacc

SEQ ID NO: 1567 - RNA, 25 nt, Homo sapiens
ggaggcggcccgugaggcggagcag

SEQ ID NO: 1568 - RNA, 25 nt, Homo sapiens
cgcaagugggaggcggcccgugagg

SEQ ID NO: 1569 - RNA, 25 nt, Homo sapiens
cagcgcaagugggaggcggcccgug

SEQ ID NO: 1570 - RNA, 25 nt, Homo sapiens
cagaucacccagcgcaagugggagg

SEQ ID NO: 1571 - RNA, 25 nt, Homo sapiens
gcucagaucacccagcgcaaguggg

SEQ ID NO: 1572 - RNA, 25 nt, Homo sapiens
gcggcucagaucacccagcgcaagu

SEQ ID NO: 1573 - RNA, 25 nt, Homo sapiens
ggcggcucagaucacccagcgcaag

SEQ ID NO: 1574 - RNA, 25 nt, Homo sapiens
cgcuccuggaccgccgcggacacgg

SEQ ID NO: 1575 - RNA, 25 nt, Homo sapiens
cugcgcuccuggaccgccgcggaca

SEQ ID NO: 1576 - RNA, 25 nt, Homo sapiens
gaggaccugcgcuccuggaccgccg

SEQ ID NO: 1577 - RNA, 25 nt, Homo sapiens
cgcccugaacgaggaccugcgcucc

SEQ ID NO: 1578 - RNA, 25 nt, Homo sapiens
ggcaaggauuacaucgcccugaacg

SEQ ID NO: 1579 - RNA, 25 nt, Homo sapiens
caugaccaguacgccuacgacggca

SEQ ID NO: 1580 - RNA, 25 nt, Homo sapiens
gcgggcaugaccaguacgccuacga

SEQ ID NO: 1581 - RNA, 25 nt, Homo sapiens
ggggccggacgggcgccuccuccgc

SEQ ID NO: 1582 - RNA, 25 nt, Homo sapiens
uggggccggacgggcgccuccuccg

SEQ ID NO: 1583 - RNA, 25 nt, Homo sapiens
guacggcugcgacguggggccggac

SEQ ID NO: 1584 - RNA, 25 nt, Homo sapiens
uguacggcugcgacguggggccgga

SEQ ID NO: 1585 - RNA, 25 nt, Homo sapiens
agcauguacggcugcgacguggggc

SEQ ID NO: 1586 - RNA, 25 nt, Homo sapiens
ccagagcauguacggcugcgacgug

SEQ ID NO: 1587 - RNA, 25 nt, Homo sapiens
uccagagcauguacggcugcgacgu

SEQ ID NO: 1588 - RNA, 25 nt, Homo sapiens
cuccagagcauguacggcugcgacg

SEQ ID NO: 1589 - RNA, 25 nt, Homo sapiens
ccucucacacccuccagagcaugua

SEQ ID NO: 1590 - RNA, 25 nt, Homo sapiens
ugcgccccgggccggggucacucac

SEQ ID NO: 1591 - RNA, 25 nt, Homo sapiens
ccggggucacucaccggccucgcuc

SEQ ID NO: 1592 - RNA, 25 nt, Homo sapiens
cucgcucugguuguaguagccgcgc

SEQ ID NO: 1593 - RNA, 25 nt, Homo sapiens
guuguaguagccgcgcagguuccgc

SEQ ID NO: 1594 - RNA, 25 nt, Homo sapiens
gccgcgcagguuccgcaggcucucu

SEQ ID NO: 1595 - RNA, 25 nt, Homo sapiens
caggcucucucggucagucugugcc

SEQ ID NO: 1596 - RNA, 25 nt, Homo sapiens
aggcucucucggucagucugugccu

SEQ ID NO: 1597 - RNA, 25 nt, Homo sapiens
cugggccuuguagaucuguguguuc

SEQ ID NO: 1598 - RNA, 25 nt, Homo sapiens
ucuguguguuccggucccaauacuc

SEQ ID NO: 1599 - RNA, 25 nt, Homo sapiens
acuccggccccuccugcucuaucca

SEQ ID NO: 1600 - RNA, 25 nt, Homo sapiens
ccuccugcucuauccacggcgcccg

SEQ ID NO: 1601 - RNA, 25 nt, Homo sapiens
uccacggcgcccgcggcuccucucu

SEQ ID NO: 1602 - RNA, 25 nt, Homo sapiens
gcccgcggcuccucucucggacucg

SEQ ID NO: 1603 - RNA, 25 nt, Homo sapiens
ggcgucgcugucgaaccucacgaac

SEQ ID NO: 1604 - RNA, 25 nt, Homo sapiens
gcgucgcugucgaaccucacgaacu

SEQ ID NO: 1605 - RNA, 25 nt, Homo sapiens
guccacguagcccacugagaugaag

SEQ ID NO: 1606 - RNA, 25 nt, Homo sapiens
uccacguagcccacugagaugaagc

SEQ ID NO: 1607 - RNA, 25 nt, Homo sapiens
ccacguagcccacugagaugaagcg

SEQ ID NO: 1608 - RNA, 25 nt, Homo sapiens
cacugagaugaagcggggcuccccg

SEQ ID NO: 1609 - RNA, 25 nt, Homo sapiens
gagaugaagcggggcuccccgcggc

SEQ ID NO: 1610 - RNA, 25 nt, Homo sapiens
agaugaagcggggcuccccgcggcc

SEQ ID NO: 1611 - RNA, 25 nt, Homo sapiens
gaagcggggcuccccgcggccgggc

SEQ ID NO: 1612 - RNA, 25 nt, Homo sapiens
aagcggggcuccccgcggccgggcc

SEQ ID NO: 1613 - RNA, 25 nt, Homo sapiens
ggcuccccgcggccgggccgggaca

SEQ ID NO: 1614 - RNA, 25 nt, Homo sapiens
uccccgcggccgggccgggacacgg

SEQ ID NO: 1615 - RNA, 25 nt, Homo sapiens
gacacggagguguagaaauaccuca

SEQ ID NO: 1616 - RNA, 25 nt, Homo sapiens
ggagguguagaaauaccucauggag

SEQ ID NO: 1617 - RNA, 25 nt, Homo sapiens
gagguguagaaauaccucauggagu

SEQ ID NO: 1618 - RNA, 25 nt, Homo sapiens
agaaauaccucauggagugggagcc

SEQ ID NO: 1619 - RNA, 25 nt, Homo sapiens
gaaauaccucauggagugggagccu

SEQ ID NO: 1620 - RNA, 25 nt, Homo sapiens
aaauaccucauggagugggagccug

SEQ ID NO: 1621 - RNA, 25 nt, Homo sapiens
aauaccucauggagugggagccugg

SEQ ID NO: 1622 - RNA, 25 nt, Homo sapiens
cucauggagugggagccugggggug

SEQ ID NO: 1623 - RNA, 25 nt, Homo sapiens
auggagugggagccugggggugagg

SEQ ID NO: 1624 - RNA, 25 nt, Homo sapiens
uggagugggagccugggggugagga

SEQ ID NO: 1625 - RNA, 25 nt, Homo sapiens
ggagugggagccugggggugaggag

SEQ ID NO: 1626 - RNA, 25 nt, Homo sapiens
gaggccggugagugaccccggcccg

SEQ ID NO: 1627 - RNA, 25 nt, Homo sapiens
cgaggccggugagugaccccggccc

SEQ ID NO: 1628 - RNA, 25 nt, Homo sapiens
gcgaggccggugagugaccccggcc

SEQ ID NO: 1629 - RNA, 25 nt, Homo sapiens
ccagagcgaggccggugagugaccc

SEQ ID NO: 1630 - RNA, 25 nt, Homo sapiens
gcggcuacuacaaccagagcgaggc

SEQ ID NO: 1631 - RNA, 25 nt, Homo sapiens
cugcgcggcuacuacaaccagagcg

SEQ ID NO: 1632 - RNA, 25 nt, Homo sapiens
accgagagagccugcggaaccugcg

SEQ ID NO: 1633 - RNA, 25 nt, Homo sapiens
ggcacagacugaccgagagagccug

SEQ ID NO: 1634 - RNA, 25 nt, Homo sapiens
cggaacacacagaucuacaaggccc

SEQ ID NO: 1635 - RNA, 25 nt, Homo sapiens
ugggaccggaacacacagaucuaca

SEQ ID NO: 1636 - RNA, 25 nt, Homo sapiens
gcaggaggggccggaguauugggac

SEQ ID NO: 1637 - RNA, 25 nt, Homo sapiens
auagagcaggaggggccggaguauu

SEQ ID NO: 1638 - RNA, 25 nt, Homo sapiens
gauagagcaggaggggccggaguau

SEQ ID NO: 1639 - RNA, 25 nt, Homo sapiens
gcgccguggauagagcaggaggggc

SEQ ID NO: 1640 - RNA, 25 nt, Homo sapiens
gcgggcgccguggauagagcaggag

SEQ ID NO: 1641 - RNA, 25 nt, Homo sapiens
cgcgggcgccguggauagagcagga

SEQ ID NO: 1642 - RNA, 25 nt, Homo sapiens
ccgcgggcgccguggauagagcagg

SEQ ID NO: 1643 - RNA, 25 nt, Homo sapiens
gagccgcgggcgccguggauagagc

SEQ ID NO: 1644 - RNA, 25 nt, Homo sapiens
uccgagagaggagccgcgggcgccg

SEQ ID NO: 1645 - RNA, 25 nt, Homo sapiens
gccgcgaguccgagagaggagccgc

SEQ ID NO: 1646 - RNA, 25 nt, Homo sapiens
cgccgcgaguccgagagaggagccg

SEQ ID NO: 1647 - RNA, 25 nt, Homo sapiens
gacagcgacgccgcgaguccgagag

SEQ ID NO: 1648 - RNA, 25 nt, Homo sapiens
cuacguggacgacacccaguucgug

SEQ ID NO: 1649 - RNA, 25 nt, Homo sapiens
ccccgcuucaucucagugggcuacg

SEQ ID NO: 1650 - RNA, 25 nt, Homo sapiens
gcggggagccccgcuucaucucagu

SEQ ID NO: 1651 - RNA, 25 nt, Homo sapiens
cgcggggagccccgcuucaucucag

SEQ ID NO: 1652 - RNA, 25 nt, Homo sapiens
accuccgugucccggcccggccgcg

SEQ ID NO: 1653 - RNA, 25 nt, Homo sapiens
caccuccgugucccggcccggccgc

SEQ ID NO: 1654 - RNA, 25 nt, Homo sapiens
acaccuccgugucccggcccggccg

SEQ ID NO: 1655 - RNA, 25 nt, Homo sapiens
auuucuacaccuccgugucccggcc

SEQ ID NO: 1656 - RNA, 25 nt, Homo sapiens
gagguauuucuacaccuccgugucc

SEQ ID NO: 1657 - RNA, 25 nt, Homo sapiens
cucacccccaggcucccacuccaug

SEQ ID NO: 1658 - RNA, 25 nt, Homo sapiens
cauuucccucccgacccgcacucac

SEQ ID NO: 1659 - RNA, 25 nt, Homo sapiens
ccucccgacccgcacucaccggccc

SEQ ID NO: 1660 - RNA, 25 nt, Homo sapiens
gacccgcacucaccggcccaggucu

SEQ ID NO: 1661 - RNA, 25 nt, Homo sapiens
gcacucaccggcccaggucucgguc

SEQ ID NO: 1662 - RNA, 25 nt, Homo sapiens
cacucaccggcccaggucucgguca

SEQ ID NO: 1663 - RNA, 25 nt, Homo sapiens
accggcccaggucucggucagggcc

SEQ ID NO: 1664 - RNA, 25 nt, Homo sapiens
ccggcccaggucucggucagggcca

SEQ ID NO: 1665 - RNA, 25 nt, Homo sapiens
cagggccagggccgccgagagcagc

SEQ ID NO: 1666 - RNA, 25 nt, Homo sapiens
ggccagggccgccgagagcagcagg

SEQ ID NO: 1667 - RNA, 25 nt, Homo sapiens
agggccgccgagagcagcaggagga

SEQ ID NO: 1668 - RNA, 25 nt, Homo sapiens
cgccgagagcagcaggaggacgguu

SEQ ID NO: 1669 - RNA, 25 nt, Homo sapiens
gccgagagcagcaggaggacgguuc

SEQ ID NO: 1670 - RNA, 25 nt, Homo sapiens
ccgagagcagcaggaggacgguucg

SEQ ID NO: 1671 - RNA, 25 nt, Homo sapiens
guucggggcgccaugaccagcaucu

SEQ ID NO: 1672 - RNA, 25 nt, Homo sapiens
gccaugaccagcaucucggcgucug

SEQ ID NO: 1673 - RNA, 25 nt, Homo sapiens
ucggcgucugaggagacucugaguc

SEQ ID NO: 1674 - RNA, 25 nt, Homo sapiens
cggcgucugaggagacucugagucc

SEQ ID NO: 1675 - RNA, 25 nt, Homo sapiens
cgucugaggagacucugaguccggg

SEQ ID NO: 1676 - RNA, 25 nt, Homo sapiens
gucugaggagacucugaguccgggu

SEQ ID NO: 1677 - RNA, 25 nt, Homo sapiens
gagacucugaguccgggugggugcg

SEQ ID NO: 1678 - RNA, 25 nt, Homo sapiens
agacucugaguccgggugggugcgu

SEQ ID NO: 1679 - RNA, 25 nt, Homo sapiens
gacucugaguccgggugggugcgug

SEQ ID NO: 1680 - RNA, 25 nt, Homo sapiens
ggugggugcguggggacuuuagaac

SEQ ID NO: 1681 - RNA, 25 nt, Homo sapiens
gugggugcguggggacuuuagaacu

SEQ ID NO: 1682 - RNA, 25 nt, Homo sapiens
cguggggacuuuagaacugggaccg

SEQ ID NO: 1683 - RNA, 25 nt, Homo sapiens
gaacugggaccgcggcgacgcugau

SEQ ID NO: 1684 - RNA, 25 nt, Homo sapiens
cugggccggugagugcgggucggga

SEQ ID NO: 1685 - RNA, 25 nt, Homo sapiens
ccugggccggugagugcgggucggg

SEQ ID NO: 1686 - RNA, 25 nt, Homo sapiens
agaccugggccggugagugcggguc

SEQ ID NO: 1687 - RNA, 25 nt, Homo sapiens
gagaccugggccggugagugcgggu

SEQ ID NO: 1688 - RNA, 25 nt, Homo sapiens
gaccgagaccugggccggugagugc

SEQ ID NO: 1689 - RNA, 25 nt, Homo sapiens
ugaccgagaccugggccggugagug

SEQ ID NO: 1690 - RNA, 25 nt, Homo sapiens
cccuggcccugaccgagaccugggc

SEQ ID NO: 1691 - RNA, 25 nt, Homo sapiens
gcggcccuggcccugaccgagaccu

SEQ ID NO: 1692 - RNA, 25 nt, Homo sapiens
ggcggcccuggcccugaccgagacc

SEQ ID NO: 1693 - RNA, 25 nt, Homo sapiens
guccuccugcugcucucggcggccc

SEQ ID NO: 1694 - RNA, 25 nt, Homo sapiens
cgaaccguccuccugcugcucucgg

SEQ ID NO: 1695 - RNA, 25 nt, Homo sapiens
ccccgaaccguccuccugcugcucu

SEQ ID NO: 1696 - RNA, 25 nt, Homo sapiens
uccucagacgccgagaugcugguca

SEQ ID NO: 1697 - RNA, 25 nt, Homo sapiens
agagucuccucagacgccgagaugc

SEQ ID NO: 1698 - RNA, 25 nt, Homo sapiens
guucuaaaguccccacgcacccacc

SEQ ID NO: 1699 - RNA, 25 nt, Homo sapiens
cucagcacagcgaacaugcaaauuc

SEQ ID NO: 1700 - RNA, 25 nt, Homo sapiens
gcacagcgaacaugcaaauucugga

SEQ ID NO: 1701 - RNA, 25 nt, Homo sapiens
aacaugcaaauucuggaagguucuc

SEQ ID NO: 1702 - RNA, 25 nt, Homo sapiens
gucuuuauuugcucucucaacuucu

SEQ ID NO: 1703 - RNA, 25 nt, Homo sapiens
uauuugagaacacaaauuuauauuc

SEQ ID NO: 1704 - RNA, 25 nt, Homo sapiens
uuauauucagguucuuaacuucauu

SEQ ID NO: 1705 - RNA, 25 nt, Homo sapiens
uauauucagguucuuaacuucauua

SEQ ID NO: 1706 - RNA, 25 nt, Homo sapiens
gugcaccaugaauuugagacagaga

SEQ ID NO: 1707 - RNA, 25 nt, Homo sapiens
auggagacauccagccccaccucuc

SEQ ID NO: 1708 - RNA, 25 nt, Homo sapiens
acauccagccccaccucucuggaac

SEQ ID NO: 1709 - RNA, 25 nt, Homo sapiens
accucucuggaacaggaaagaugau

SEQ ID NO: 1710 - RNA, 25 nt, Homo sapiens
ccucucuggaacaggaaagaugauc

SEQ ID NO: 1711 - RNA, 25 nt, Homo sapiens
cucucuggaacaggaaagaugaucg

SEQ ID NO: 1712 - RNA, 25 nt, Homo sapiens
ucuggaacaggaaagaugaucgggg

SEQ ID NO: 1713 - RNA, 25 nt, Homo sapiens
cuggaacaggaaagaugaucgggga

SEQ ID NO: 1714 - RNA, 25 nt, Homo sapiens
ggaaagaugaucggggagggaacac

SEQ ID NO: 1715 - RNA, 25 nt, Homo sapiens
aucggggagggaacacaggucagug

SEQ ID NO: 1716 - RNA, 25 nt, Homo sapiens
ucggggagggaacacaggucagugu

SEQ ID NO: 1717 - RNA, 25 nt, Homo sapiens
cggggagggaacacaggucagugug

SEQ ID NO: 1718 - RNA, 25 nt, Homo sapiens
agggaacacaggucaguguggggac

SEQ ID NO: 1719 - RNA, 25 nt, Homo sapiens
gggaacacaggucaguguggggaca

SEQ ID NO: 1720 - RNA, 25 nt, Homo sapiens
ggaacacaggucaguguggggacag

SEQ ID NO: 1721 - RNA, 25 nt, Homo sapiens
caggucaguguggggacagggguca

SEQ ID NO: 1722 - RNA, 25 nt, Homo sapiens
gucaguguggggacaggggucacgg

SEQ ID NO: 1723 - RNA, 25 nt, Homo sapiens
guggggacaggggucacgguggaca

SEQ ID NO: 1724 - RNA, 25 nt, Homo sapiens
uggggacaggggucacgguggacac

SEQ ID NO: 1725 - RNA, 25 nt, Homo sapiens
ggggacaggggucacgguggacacg

SEQ ID NO: 1726 - RNA, 25 nt, Homo sapiens
gggacaggggucacgguggacacgg

SEQ ID NO: 1727 - RNA, 25 nt, Homo sapiens
acaggggucacgguggacacggggg

SEQ ID NO: 1728 - RNA, 25 nt, Homo sapiens
caggggucacgguggacacgggggu

SEQ ID NO: 1729 - RNA, 25 nt, Homo sapiens
cuccaccuccucacauuaugcuaac

SEQ ID NO: 1730 - RNA, 25 nt, Homo sapiens
ugcuaacaggaacgcagacacauuc

SEQ ID NO: 1731 - RNA, 25 nt, Homo sapiens
gugccuuugcagaaagagaugccag

SEQ ID NO: 1732 - RNA, 25 nt, Homo sapiens
augccagaggcucuugaagucacaa

SEQ ID NO: 1733 - RNA, 25 nt, Homo sapiens
agaggcucuugaagucacaaaggag

SEQ ID NO: 1734 - RNA, 25 nt, Homo sapiens
gaaauccugcaucucagucccacac

SEQ ID NO: 1735 - RNA, 25 nt, Homo sapiens
ucagucccacacaggcagcugucuc

SEQ ID NO: 1736 - RNA, 25 nt, Homo sapiens
ucaaauauuugcuaugaagcguuga

SEQ ID NO: 1737 - RNA, 25 nt, Homo sapiens
ugucuccaucucugucucaaauuca

SEQ ID NO: 1738 - RNA, 25 nt, Homo sapiens
cuuuccuguuccagagagguggggc

SEQ ID NO: 1739 - RNA, 25 nt, Homo sapiens
ucaucuuuccuguuccagagaggug

SEQ ID NO: 1740 - RNA, 25 nt, Homo sapiens
aucaucuuuccuguuccagagaggu

SEQ ID NO: 1741 - RNA, 25 nt, Homo sapiens
gaucaucuuuccuguuccagagagg

SEQ ID NO: 1742 - RNA, 25 nt, Homo sapiens
cccgaucaucuuuccuguuccagag

SEQ ID NO: 1743 - RNA, 25 nt, Homo sapiens
uuccuguuagcauaaugugaggagg

SEQ ID NO: 1744 - RNA, 25 nt, Homo sapiens
gcguuccuguuagcauaaugugagg

SEQ ID NO: 1745 - RNA, 25 nt, Homo sapiens
ucugcguuccuguuagcauaaugug

SEQ ID NO: 1746 - RNA, 25 nt, Homo sapiens
gagccucuggcaucucuuucugcaa

SEQ ID NO: 1747 - RNA, 25 nt, Homo sapiens
ucuccuuugugacuucaagagccuc

SEQ ID NO: 1748 - RNA, 25 nt, Homo sapiens
agcugccugugugggacugagaugc

SEQ ID NO: 1749 - RNA, 25 nt, Homo sapiens
uguagccugagacagcugccugugu

SEQ ID NO: 1750 - RNA, 25 nt, Homo sapiens
cuguagccugagacagcugccugug

SEQ ID NO: 1751 - RNA, 25 nt, Homo sapiens
agugaugagagacucaucagagccc

SEQ ID NO: 1752 - RNA, 25 nt, Homo sapiens
gugaugagagacucaucagagcccu

SEQ ID NO: 1753 - RNA, 25 nt, Homo sapiens
cagagcccugggcacuguugcugcc

SEQ ID NO: 1754 - RNA, 25 nt, Homo sapiens
agagcccugggcacuguugcugccu

SEQ ID NO: 1755 - RNA, 25 nt, Homo sapiens
gagcccugggcacuguugcugccug

SEQ ID NO: 1756 - RNA, 25 nt, Homo sapiens
aaggugagauucuggggagcugaag

SEQ ID NO: 1757 - RNA, 25 nt, Homo sapiens
caucacuuguaaaggugagauucug

SEQ ID NO: 1758 - RNA, 25 nt, Homo sapiens
ucaucacuuguaaaggugagauucu

SEQ ID NO: 1759 - RNA, 25 nt, Homo sapiens
cucaucacuuguaaaggugagauuc

SEQ ID NO: 1760 - RNA, 25 nt, Homo sapiens
cugaugagucucucaucacuuguaa

SEQ ID NO: 1761 - RNA, 25 nt, Homo sapiens
cuaccccaggcagcaacagugccca

SEQ ID NO: 1762 - RNA, 25 nt, Homo sapiens
ucuaccccaggcagcaacagugccc

SEQ ID NO: 1763 - RNA, 25 nt, Homo sapiens
gagcagcucccuccuuuuccaccug

SEQ ID NO: 1764 - RNA, 25 nt, Homo sapiens
agcagcucccuccuuuuccaccugu

SEQ ID NO: 1765 - RNA, 25 nt, Homo sapiens
cguguaagugauggcggcgggcgug

SEQ ID NO: 1766 - RNA, 25 nt, Homo sapiens
caggcugcguguaagugauggcggc

SEQ ID NO: 1767 - RNA, 25 nt, Homo sapiens
ucaggcugcguguaagugauggcgg

SEQ ID NO: 1768 - RNA, 25 nt, Homo sapiens
cucucaggcugcguguaagugaugg

SEQ ID NO: 1769 - RNA, 25 nt, Homo sapiens
cugcucucaggcugcguguaaguga

SEQ ID NO: 1770 - RNA, 25 nt, Homo sapiens
gguggaaaaggagggagcugcucuc

SEQ ID NO: 1771 - RNA, 25 nt, Homo sapiens
uuuucuucccacagguggaaaagga

SEQ ID NO: 1772 - RNA, 25 nt, Homo sapiens
auuuucuucccacagguggaaaagg

SEQ ID NO: 1773 - RNA, 25 nt, Homo sapiens
ggcauuuucuucccacagguggaaa

SEQ ID NO: 1774 - RNA, 25 nt, Homo sapiens
ucauagggcauuuucuucccacagg

SEQ ID NO: 1775 - RNA, 25 nt, Homo sapiens
gagcucuuccuccuacacaucauag

SEQ ID NO: 1776 - RNA, 25 nt, Homo sapiens
caucauagcggugaccacagcucca

SEQ ID NO: 1777 - RNA, 25 nt, Homo sapiens
ggugaccacagcuccaaggacagcu

SEQ ID NO: 1778 - RNA, 25 nt, Homo sapiens
agcuccaaggacagcuaggacaacc

SEQ ID NO: 1779 - RNA, 25 nt, Homo sapiens
gacagcuaggacaaccaggacagcc

SEQ ID NO: 1780 - RNA, 25 nt, Homo sapiens
gccaggccagcaacgaugcccauga

SEQ ID NO: 1781 - RNA, 25 nt, Homo sapiens
ccaggccagcaacgaugcccaugau

SEQ ID NO: 1782 - RNA, 25 nt, Homo sapiens
caggccagcaacgaugcccaugaug

SEQ ID NO: 1783 - RNA, 25 nt, Homo sapiens
ccagcaacgaugcccaugaugggga

SEQ ID NO: 1784 - RNA, 25 nt, Homo sapiens
gcaacgaugcccaugauggggaugg

SEQ ID NO: 1785 - RNA, 25 nt, Homo sapiens
caacgaugcccaugauggggauggu

SEQ ID NO: 1786 - RNA, 25 nt, Homo sapiens
gaugcccaugauggggauggugggc

SEQ ID NO: 1787 - RNA, 25 nt, Homo sapiens
augcccaugauggggauggugggcu

SEQ ID NO: 1788 - RNA, 25 nt, Homo sapiens
ugauggggauggugggcugggaaga

SEQ ID NO: 1789 - RNA, 25 nt, Homo sapiens
ggauggugggcugggaagauggcuc

SEQ ID NO: 1790 - RNA, 25 nt, Homo sapiens
gauggugggcugggaagauggcucu

SEQ ID NO: 1791 - RNA, 25 nt, Homo sapiens
ugggcugggaagauggcucugggaa

SEQ ID NO: 1792 - RNA, 25 nt, Homo sapiens
gcugggaagauggcucugggaaagg

SEQ ID NO: 1793 - RNA, 25 nt, Homo sapiens
aagauggcucugggaaaggaggaga

SEQ ID NO: 1794 - RNA, 25 nt, Homo sapiens
ggcucugggaaaggaggagaaggug

SEQ ID NO: 1795 - RNA, 25 nt, Homo sapiens
gcucugggaaaggaggagaagguga

SEQ ID NO: 1796 - RNA, 25 nt, Homo sapiens
ucagguagggaaggggugaagagcg

SEQ ID NO: 1797 - RNA, 25 nt, Homo sapiens
cucagguagggaaggggugaagagc

SEQ ID NO: 1798 - RNA, 25 nt, Homo sapiens
gcucagguagggaaggggugaagag

SEQ ID NO: 1799 - RNA, 25 nt, Homo sapiens
aggaggaagagcucagguagggaag

SEQ ID NO: 1800 - RNA, 25 nt, Homo sapiens
uaggaggaagagcucagguagggaa

SEQ ID NO: 1801 - RNA, 25 nt, Homo sapiens
guaggaggaagagcucagguaggga

SEQ ID NO: 1802 - RNA, 25 nt, Homo sapiens
auguguaggaggaagagcucaggua

SEQ ID NO: 1803 - RNA, 25 nt, Homo sapiens
gauguguaggaggaagagcucaggu

SEQ ID NO: 1804 - RNA, 25 nt, Homo sapiens
cuaugauguguaggaggaagagcuc

SEQ ID NO: 1805 - RNA, 25 nt, Homo sapiens
uguggucaccgcuaugauguguagg

SEQ ID NO: 1806 - RNA, 25 nt, Homo sapiens
agcuguggucaccgcuaugaugugu

SEQ ID NO: 1807 - RNA, 25 nt, Homo sapiens
guuguccuagcuguccuuggagcug

SEQ ID NO: 1808 - RNA, 25 nt, Homo sapiens
cuguccugguuguccuagcuguccu

SEQ ID NO: 1809 - RNA, 25 nt, Homo sapiens
ggcaucguugcuggccuggcugucc

SEQ ID NO: 1810 - RNA, 25 nt, Homo sapiens
cccaucaugggcaucguugcuggcc

SEQ ID NO: 1811 - RNA, 25 nt, Homo sapiens
ccauccccaucaugggcaucguugc

SEQ ID NO: 1812 - RNA, 25 nt, Homo sapiens
cuucccagcccaccauccccaucau

SEQ ID NO: 1813 - RNA, 25 nt, Homo sapiens
ucuucccagcccaccauccccauca

SEQ ID NO: 1814 - RNA, 25 nt, Homo sapiens
cccauuccccuccuuaccccagcuc

SEQ ID NO: 1815 - RNA, 25 nt, Homo sapiens
ccauuccccuccuuaccccagcuca

SEQ ID NO: 1816 - RNA, 25 nt, Homo sapiens
ccccuccuuaccccagcucagggug

SEQ ID NO: 1817 - RNA, 25 nt, Homo sapiens
cccuccuuaccccagcucaggguga

SEQ ID NO: 1818 - RNA, 25 nt, Homo sapiens
ccuccuuaccccagcucagggugag

SEQ ID NO: 1819 - RNA, 25 nt, Homo sapiens
cucuugcagccccucgugcugcaua

SEQ ID NO: 1820 - RNA, 25 nt, Homo sapiens
acguguaucucugcucuuguccaga

SEQ ID NO: 1821 - RNA, 25 nt, Homo sapiens
aggcaccaccacagcugcccacuuc

SEQ ID NO: 1822 - RNA, 25 nt, Homo sapiens
accaccacagcugcccacuucugga

SEQ ID NO: 1823 - RNA, 25 nt, Homo sapiens
acuucuggaagguuccaucuccugc

SEQ ID NO: 1824 - RNA, 25 nt, Homo sapiens
uggaagguuccaucuccugcuggcc

SEQ ID NO: 1825 - RNA, 25 nt, Homo sapiens
ccugcuggccuggucuccacaagcu

SEQ ID NO: 1826 - RNA, 25 nt, Homo sapiens
ccuggucuccacaagcucggugucc

SEQ ID NO: 1827 - RNA, 25 nt, Homo sapiens
cuggucuccacaagcucgguguccu

SEQ ID NO: 1828 - RNA, 25 nt, Homo sapiens
cuccacaagcucgguguccuggguc

SEQ ID NO: 1829 - RNA, 25 nt, Homo sapiens
gucugguccuccccaucccgcugcc

SEQ ID NO: 1830 - RNA, 25 nt, Homo sapiens
gcugccaggucagugugaucuccgc

SEQ ID NO: 1831 - RNA, 25 nt, Homo sapiens
cugccaggucagugugaucuccgca

SEQ ID NO: 1832 - RNA, 25 nt, Homo sapiens
ugugaucuccgcaggguagaagccc

SEQ ID NO: 1833 - RNA, 25 nt, Homo sapiens
gugaucuccgcaggguagaagccca

SEQ ID NO: 1834 - RNA, 25 nt, Homo sapiens
guagaagcccagggcccagcaccuc

SEQ ID NO: 1835 - RNA, 25 nt, Homo sapiens
uagaagcccagggcccagcaccuca

SEQ ID NO: 1836 - RNA, 25 nt, Homo sapiens
aagcccagggcccagcaccucaggg

SEQ ID NO: 1837 - RNA, 25 nt, Homo sapiens
ggcccagcaccucaggguggccuca

SEQ ID NO: 1838 - RNA, 25 nt, Homo sapiens
ccucaggguggccucauggucagag

SEQ ID NO: 1839 - RNA, 25 nt, Homo sapiens
cucaggguggccucauggucagaga

SEQ ID NO: 1840 - RNA, 25 nt, Homo sapiens
ucaggguggccucauggucagagag

SEQ ID NO: 1841 - RNA, 25 nt, Homo sapiens
caggguggccucauggucagagagg

SEQ ID NO: 1842 - RNA, 25 nt, Homo sapiens
gguggccucauggucagagaggggg

SEQ ID NO: 1843 - RNA, 25 nt, Homo sapiens
ggccucauggucagagagggggugg

SEQ ID NO: 1844 - RNA, 25 nt, Homo sapiens
gccucauggucagagaggggguggu

SEQ ID NO: 1845 - RNA, 25 nt, Homo sapiens
ggggguggugggucacgugugucuu

SEQ ID NO: 1846 - RNA, 25 nt, Homo sapiens
gggguggugggucacgugugucuuu

SEQ ID NO: 1847 - RNA, 25 nt, Homo sapiens
ggguggugggucacgugugucuuug

SEQ ID NO: 1848 - RNA, 25 nt, Homo sapiens
gguggugggucacgugugucuuugg

SEQ ID NO: 1849 - RNA, 25 nt, Homo sapiens
ucacgugugucuuuggggguucuga

SEQ ID NO: 1850 - RNA, 25 nt, Homo sapiens
cacgugugucuuuggggguucugac

SEQ ID NO: 1851 - RNA, 25 nt, Homo sapiens
gagcugggguaaggaggggaauggg

SEQ ID NO: 1852 - RNA, 25 nt, Homo sapiens
ugagcugggguaaggaggggaaugg

SEQ ID NO: 1853 - RNA, 25 nt, Homo sapiens
cugagcugggguaaggaggggaaug

SEQ ID NO: 1854 - RNA, 25 nt, Homo sapiens
ccugagcugggguaaggaggggaau

SEQ ID NO: 1855 - RNA, 25 nt, Homo sapiens
cccugagcugggguaaggaggggaa

SEQ ID NO: 1856 - RNA, 25 nt, Homo sapiens
ccucacccugagcugggguaaggag

SEQ ID NO: 1857 - RNA, 25 nt, Homo sapiens
cccucacccugagcugggguaagga

SEQ ID NO: 1858 - RNA, 25 nt, Homo sapiens
ccccucacccugagcugggguaagg

SEQ ID NO: 1859 - RNA, 25 nt, Homo sapiens
gagccccucacccugagcuggggua

SEQ ID NO: 1860 - RNA, 25 nt, Homo sapiens
ugcaagagccccucacccugagcug

SEQ ID NO: 1861 - RNA, 25 nt, Homo sapiens
cugcaagagccccucacccugagcu

SEQ ID NO: 1862 - RNA, 25 nt, Homo sapiens
gcugcaagagccccucacccugagc

SEQ ID NO: 1863 - RNA, 25 nt, Homo sapiens
auacacgugccauaugcagcacgag

SEQ ID NO: 1864 - RNA, 25 nt, Homo sapiens
gauacacgugccauaugcagcacga

SEQ ID NO: 1865 - RNA, 25 nt, Homo sapiens
agauacacgugccauaugcagcacg

SEQ ID NO: 1866 - RNA, 25 nt, Homo sapiens
agugggcagcugugguggugccuuc

SEQ ID NO: 1867 - RNA, 25 nt, Homo sapiens
accuuccagaagugggcagcugugg

SEQ ID NO: 1868 - RNA, 25 nt, Homo sapiens
ggaaccuuccagaagugggcagcug

SEQ ID NO: 1869 - RNA, 25 nt, Homo sapiens
gcaggagauggaaccuuccagaagu

SEQ ID NO: 1870 - RNA, 25 nt, Homo sapiens
agcaggagauggaaccuuccagaag

SEQ ID NO: 1871 - RNA, 25 nt, Homo sapiens
uuguggagaccaggccagcaggaga

SEQ ID NO: 1872 - RNA, 25 nt, Homo sapiens
ccgagcuuguggagaccaggccagc

SEQ ID NO: 1873 - RNA, 25 nt, Homo sapiens
ccaggacaccgagcuuguggagacc

SEQ ID NO: 1874 - RNA, 25 nt, Homo sapiens
gaccagacccaggacaccgagcuug

SEQ ID NO: 1875 - RNA, 25 nt, Homo sapiens
cagcgggauggggaggaccagaccc

SEQ ID NO: 1876 - RNA, 25 nt, Homo sapiens
acacugaccuggcagcgggaugggg

SEQ ID NO: 1877 - RNA, 25 nt, Homo sapiens
aucacacugaccuggcagcgggaug

SEQ ID NO: 1878 - RNA, 25 nt, Homo sapiens
gaucacacugaccuggcagcgggau

SEQ ID NO: 1879 - RNA, 25 nt, Homo sapiens
agaucacacugaccuggcagcggga

SEQ ID NO: 1880 - RNA, 25 nt, Homo sapiens
gcggagaucacacugaccuggcagc

SEQ ID NO: 1881 - RNA, 25 nt, Homo sapiens
ugcggagaucacacugaccuggcag

SEQ ID NO: 1882 - RNA, 25 nt, Homo sapiens
cuacccugcggagaucacacugacc

SEQ ID NO: 1883 - RNA, 25 nt, Homo sapiens
ugcugggcccugggcuucuacccug

SEQ ID NO: 1884 - RNA, 25 nt, Homo sapiens
aggccacccugaggugcugggcccu

SEQ ID NO: 1885 - RNA, 25 nt, Homo sapiens
gaggccacccugaggugcugggccc

SEQ ID NO: 1886 - RNA, 25 nt, Homo sapiens
gaccaugaggccacccugaggugcu

SEQ ID NO: 1887 - RNA, 25 nt, Homo sapiens
ugaccaugaggccacccugaggugc

SEQ ID NO: 1888 - RNA, 25 nt, Homo sapiens
ccucucugaccaugaggccacccug

SEQ ID NO: 1889 - RNA, 25 nt, Homo sapiens
acccaccacccccucucugaccaug

SEQ ID NO: 1890 - RNA, 25 nt, Homo sapiens
cugcagcgucuccuucccguucucc

SEQ ID NO: 1891 - RNA, 25 nt, Homo sapiens
cuccuucccguucuccagguaucug

SEQ ID NO: 1892 - RNA, 25 nt, Homo sapiens
gagccacuccacgcacgugcccucc

SEQ ID NO: 1893 - RNA, 25 nt, Homo sapiens
cacuccacgcacgugcccuccaggu

SEQ ID NO: 1894 - RNA, 25 nt, Homo sapiens
guaggcucucagcugcuccgccgca

SEQ ID NO: 1895 - RNA, 25 nt, Homo sapiens
uaggcucucagcugcuccgccgcac

SEQ ID NO: 1896 - RNA, 25 nt, Homo sapiens
cgcacgggccgccuccaacuugcgc

SEQ ID NO: 1897 - RNA, 25 nt, Homo sapiens
gcacgggccgccuccaacuugcgcu

SEQ ID NO: 1898 - RNA, 25 nt, Homo sapiens
aacuugcgcugggugaucugagccg

SEQ ID NO: 1899 - RNA, 25 nt, Homo sapiens
ugggugaucugagccgcgguguccg

SEQ ID NO: 1900 - RNA, 25 nt, Homo sapiens
gugaucugagccgcgguguccgcgg

SEQ ID NO: 1901 - RNA, 25 nt, Homo sapiens
ugagccgcgguguccgcggcggucc

SEQ ID NO: 1902 - RNA, 25 nt, Homo sapiens
gguguccgcggcgguccaggagcgc

SEQ ID NO: 1903 - RNA, 25 nt, Homo sapiens
gguccaggagcgcagguccucguuc

SEQ ID NO: 1904 - RNA, 25 nt, Homo sapiens
guccaggagcgcagguccucguuca

SEQ ID NO: 1905 - RNA, 25 nt, Homo sapiens
agggcgauguaauccuugccgucgu

SEQ ID NO: 1906 - RNA, 25 nt, Homo sapiens
gcgauguaauccuugccgucguagg

SEQ ID NO: 1907 - RNA, 25 nt, Homo sapiens
guaauccuugccgucguaggcggac

SEQ ID NO: 1908 - RNA, 25 nt, Homo sapiens
gucguaggcggacuggucauacccg

SEQ ID NO: 1909 - RNA, 25 nt, Homo sapiens
guaggcggacuggucauacccgcgg

SEQ ID NO: 1910 - RNA, 25 nt, Homo sapiens
ggcggacuggucauacccgcggagg

SEQ ID NO: 1911 - RNA, 25 nt, Homo sapiens
ucauacccgcggaggaggcgcccgu

SEQ ID NO: 1912 - RNA, 25 nt, Homo sapiens
cauacccgcggaggaggcgcccguc

SEQ ID NO: 1913 - RNA, 25 nt, Homo sapiens
gcggaggaggcgcccgucgggcccc

SEQ ID NO: 1914 - RNA, 25 nt, Homo sapiens
ccccaggucgcagccagacauccuc

SEQ ID NO: 1915 - RNA, 25 nt, Homo sapiens
caggucgcagccagacauccucugg

SEQ ID NO: 1916 - RNA, 25 nt, Homo sapiens
aggucgcagccagacauccucugga

SEQ ID NO: 1917 - RNA, 25 nt, Homo sapiens
acauccucuggagggugugagaccc

SEQ ID NO: 1918 - RNA, 25 nt, Homo sapiens
gugugagacccuggccccgcccccg

SEQ ID NO: 1919 - RNA, 25 nt, Homo sapiens
cagcgcgcagguaccaggggcagug

SEQ ID NO: 1920 - RNA, 25 nt, Homo sapiens
gcagcgcgcagguaccaggggcagu

SEQ ID NO: 1921 - RNA, 25 nt, Homo sapiens
ugcagcgcgcagguaccaggggcag

SEQ ID NO: 1922 - RNA, 25 nt, Homo sapiens
agacgcugcagcgcgcagguaccag

SEQ ID NO: 1923 - RNA, 25 nt, Homo sapiens
gagacgcugcagcgcgcagguacca

SEQ ID NO: 1924 - RNA, 25 nt, Homo sapiens
ggagacgcugcagcgcgcagguacc

SEQ ID NO: 1925 - RNA, 25 nt, Homo sapiens
acgggaaggagacgcugcagcgcgc

SEQ ID NO: 1926 - RNA, 25 nt, Homo sapiens
cuccgcagauaccuggagaacggga

SEQ ID NO: 1927 - RNA, 25 nt, Homo sapiens
guggcuccgcagauaccuggagaac

SEQ ID NO: 1928 - RNA, 25 nt, Homo sapiens
aguggcuccgcagauaccuggagaa

SEQ ID NO: 1929 - RNA, 25 nt, Homo sapiens
ugcguggaguggcuccgcagauacc

SEQ ID NO: 1930 - RNA, 25 nt, Homo sapiens
cuaccuggagggcacgugcguggag

SEQ ID NO: 1931 - RNA, 25 nt, Homo sapiens
agagccuaccuggagggcacgugcg

SEQ ID NO: 1932 - RNA, 25 nt, Homo sapiens
cggagcagcugagagccuaccugga

SEQ ID NO: 1933 - RNA, 25 nt, Homo sapiens
gcggagcagcugagagccuaccugg

SEQ ID NO: 1934 - RNA, 25 nt, Homo sapiens
gcggcggagcagcugagagccuacc

SEQ ID NO: 1935 - RNA, 25 nt, Homo sapiens
cgcaaguuggaggcggcccgugcgg

SEQ ID NO: 1936 - RNA, 25 nt, Homo sapiens
cagcgcaaguuggaggcggcccgug

SEQ ID NO: 1937 - RNA, 25 nt, Homo sapiens
cagaucacccagcgcaaguuggagg

SEQ ID NO: 1938 - RNA, 25 nt, Homo sapiens
gcucagaucacccagcgcaaguugg

SEQ ID NO: 1939 - RNA, 25 nt, Homo sapiens
gcggcucagaucacccagcgcaagu

SEQ ID NO: 1940 - RNA, 25 nt, Homo sapiens
cgcuccuggaccgccgcggacaccg

SEQ ID NO: 1941 - RNA, 25 nt, Homo sapiens
gaggaccugcgcuccuggaccgccg

SEQ ID NO: 1942 - RNA, 25 nt, Homo sapiens
cgcccugaacgaggaccugcgcucc

SEQ ID NO: 1943 - RNA, 25 nt, Homo sapiens
ggcaaggauuacaucgcccugaacg

SEQ ID NO: 1944 - RNA, 25 nt, Homo sapiens
uaugaccaguccgccuacgacggca

SEQ ID NO: 1945 - RNA, 25 nt, Homo sapiens
gcggguaugaccaguccgccuacga

SEQ ID NO: 1946 - RNA, 25 nt, Homo sapiens
ggggcccgacgggcgccuccuccgc

SEQ ID NO: 1947 - RNA, 25 nt, Homo sapiens
uggggcccgacgggcgccuccuccg

SEQ ID NO: 1948 - RNA, 25 nt, Homo sapiens
gucuggcugcgaccuggggcccgac

SEQ ID NO: 1949 - RNA, 25 nt, Homo sapiens
ugucuggcugcgaccuggggcccga

SEQ ID NO: 1950 - RNA, 25 nt, Homo sapiens
ccagaggaugucuggcugcgaccug

SEQ ID NO: 1951 - RNA, 25 nt, Homo sapiens
uccagaggaugucuggcugcgaccu

SEQ ID NO: 1952 - RNA, 25 nt, Homo sapiens
cuccagaggaugucuggcugcgacc

SEQ ID NO: 1953 - RNA, 25 nt, Homo sapiens
ggucucacacccuccagaggauguc

SEQ ID NO: 1954 - RNA, 25 nt, Homo sapiens
ggggccagggucucacacccuccag

SEQ ID NO: 1955 - RNA, 25 nt, Homo sapiens
ccggggucacucaccguccucgcuc

SEQ ID NO: 1956 - RNA, 25 nt, Homo sapiens
cucgcucugguuguaguagccgcgc

SEQ ID NO: 1957 - RNA, 25 nt, Homo sapiens
guuguaguagccgcgcagguuccgc

SEQ ID NO: 1958 - RNA, 25 nt, Homo sapiens
gccgcgcagguuccgcaggcucacu

SEQ ID NO: 1959 - RNA, 25 nt, Homo sapiens
caggcucacucggucagccugugcc

SEQ ID NO: 1960 - RNA, 25 nt, Homo sapiens
cuggcgcuuguacuucugugucucc

SEQ ID NO: 1961 - RNA, 25 nt, Homo sapiens
ucugugucucccggucccaauacuc

SEQ ID NO: 1962 - RNA, 25 nt, Homo sapiens
acuccggccccuccugcuccaccca

SEQ ID NO: 1963 - RNA, 25 nt, Homo sapiens
ccuccugcuccacccacggcgcccg

SEQ ID NO: 1964 - RNA, 25 nt, Homo sapiens
cccacggcgcccgcggcuccccucu

SEQ ID NO: 1965 - RNA, 25 nt, Homo sapiens
gcccgcggcuccccucucggacucg

SEQ ID NO: 1966 - RNA, 25 nt, Homo sapiens
guccacguagcccacugagaugaag

SEQ ID NO: 1967 - RNA, 25 nt, Homo sapiens
uccacguagcccacugagaugaagc

SEQ ID NO: 1968 - RNA, 25 nt, Homo sapiens
ccacguagcccacugagaugaagcg

SEQ ID NO: 1969 - RNA, 25 nt, Homo sapiens
cacugagaugaagcggggcucuccg

SEQ ID NO: 1970 - RNA, 25 nt, Homo sapiens
gagaugaagcggggcucuccgcggc

SEQ ID NO: 1971 - RNA, 25 nt, Homo sapiens
agaugaagcggggcucuccgcggcc

SEQ ID NO: 1972 - RNA, 25 nt, Homo sapiens
gaagcggggcucuccgcggccgggc

SEQ ID NO: 1973 - RNA, 25 nt, Homo sapiens
aagcggggcucuccgcggccgggcc

SEQ ID NO: 1974 - RNA, 25 nt, Homo sapiens
ggcucuccgcggccgggccgggaca

SEQ ID NO: 1975 - RNA, 25 nt, Homo sapiens
ucuccgcggccgggccgggacacgg

SEQ ID NO: 1976 - RNA, 25 nt, Homo sapiens
gacacggcggugucgaaauaccuca

SEQ ID NO: 1977 - RNA, 25 nt, Homo sapiens
ggcggugucgaaauaccucauggag

SEQ ID NO: 1978 - RNA, 25 nt, Homo sapiens
gcggugucgaaauaccucauggagu

SEQ ID NO: 1979 - RNA, 25 nt, Homo sapiens
cgaaauaccucauggagugggagcc

SEQ ID NO: 1980 - RNA, 25 nt, Homo sapiens
gaaauaccucauggagugggagccu

SEQ ID NO: 1981 - RNA, 25 nt, Homo sapiens
aaauaccucauggagugggagccug

SEQ ID NO: 1982 - RNA, 25 nt, Homo sapiens
aauaccucauggagugggagccugg

SEQ ID NO: 1983 - RNA, 25 nt, Homo sapiens
cucauggagugggagccugggggcg

SEQ ID NO: 1984 - RNA, 25 nt, Homo sapiens
auggagugggagccugggggcgagg

SEQ ID NO: 1985 - RNA, 25 nt, Homo sapiens
uggagugggagccugggggcgagga

SEQ ID NO: 1986 - RNA, 25 nt, Homo sapiens
ggagugggagccugggggcgaggag

SEQ ID NO: 1987 - RNA, 25 nt, Homo sapiens
gaggacggugagugaccccggcccg

SEQ ID NO: 1988 - RNA, 25 nt, Homo sapiens
cgaggacggugagugaccccggccc

SEQ ID NO: 1989 - RNA, 25 nt, Homo sapiens
gcgaggacggugagugaccccggcc

SEQ ID NO: 1990 - RNA, 25 nt, Homo sapiens
ccagagcgaggacggugagugaccc

SEQ ID NO: 1991 - RNA, 25 nt, Homo sapiens
gcggcuacuacaaccagagcgagga

SEQ ID NO: 1992 - RNA, 25 nt, Homo sapiens
cugcgcggcuacuacaaccagagcg

SEQ ID NO: 1993 - RNA, 25 nt, Homo sapiens
accgagugagccugcggaaccugcg

SEQ ID NO: 1994 - RNA, 25 nt, Homo sapiens
ggcacaggcugaccgagugagccug

SEQ ID NO: 1995 - RNA, 25 nt, Homo sapiens
acacagaaguacaagcgccaggcac

SEQ ID NO: 1996 - RNA, 25 nt, Homo sapiens
cgggagacacagaaguacaagcgcc

SEQ ID NO: 1997 - RNA, 25 nt, Homo sapiens
caggaggggccggaguauugggacc

SEQ ID NO: 1998 - RNA, 25 nt, Homo sapiens
gcaggaggggccggaguauugggac

SEQ ID NO: 1999 - RNA, 25 nt, Homo sapiens
guggagcaggaggggccggaguauu

SEQ ID NO: 2000 - RNA, 25 nt, Homo sapiens
gguggagcaggaggggccggaguau

SEQ ID NO: 2001 - RNA, 25 nt, Homo sapiens
gcgccguggguggagcaggaggggc

SEQ ID NO: 2002 - RNA, 25 nt, Homo sapiens
gcgggcgccguggguggagcaggag

SEQ ID NO: 2003 - RNA, 25 nt, Homo sapiens
cgcgggcgccguggguggagcagga

SEQ ID NO: 2004 - RNA, 25 nt, Homo sapiens
ccgcgggcgccguggguggagcagg

SEQ ID NO: 2005 - RNA, 25 nt, Homo sapiens
gagccgcgggcgccguggguggagc

SEQ ID NO: 2006 - RNA, 25 nt, Homo sapiens
agaggggagccgcgggcgccguggg

SEQ ID NO: 2007 - RNA, 25 nt, Homo sapiens
ccgagaggggagccgcgggcgccgu

SEQ ID NO: 2008 - RNA, 25 nt, Homo sapiens
uccgagaggggagccgcgggcgccg

SEQ ID NO: 2009 - RNA, 25 nt, Homo sapiens
gccgcgaguccgagaggggagccgc

SEQ ID NO: 2010 - RNA, 25 nt, Homo sapiens
cgccgcgaguccgagaggggagccg

SEQ ID NO: 2011 - RNA, 25 nt, Homo sapiens
gacagcgacgccgcgaguccgagag

SEQ ID NO: 2012 - RNA, 25 nt, Homo sapiens
cgacagcgacgccgcgaguccgaga

SEQ ID NO: 2013 - RNA, 25 nt, Homo sapiens
ucgacagcgacgccgcgaguccgag

SEQ ID NO: 2014 - RNA, 25 nt, Homo sapiens
cuacguggacgacacgcaguucgug

SEQ ID NO: 2015 - RNA, 25 nt, Homo sapiens
ccccgcuucaucucagugggcuacg

SEQ ID NO: 2016 - RNA, 25 nt, Homo sapiens
gcggagagccccgcuucaucucagu

SEQ ID NO: 2017 - RNA, 25 nt, Homo sapiens
cgcggagagccccgcuucaucucag

SEQ ID NO: 2018 - RNA, 25 nt, Homo sapiens
acaccgccgugucccggcccggccg

SEQ ID NO: 2019 - RNA, 25 nt, Homo sapiens
auuucgacaccgccgugucccggcc

SEQ ID NO: 2020 - RNA, 25 nt, Homo sapiens
gagguauuucgacaccgccgugucc

SEQ ID NO: 2021 - RNA, 25 nt, Homo sapiens
cucgcccccaggcucccacuccaug

SEQ ID NO: 2022 - RNA, 25 nt, Homo sapiens
gcuucccucccaaccccgcacucac

SEQ ID NO: 2023 - RNA, 25 nt, Homo sapiens
cucccaaccccgcacucacaggccc

SEQ ID NO: 2024 - RNA, 25 nt, Homo sapiens
accccgcacucacaggcccaggucu

SEQ ID NO: 2025 - RNA, 25 nt, Homo sapiens
gcacucacaggcccaggucucgguc

SEQ ID NO: 2026 - RNA, 25 nt, Homo sapiens
cacucacaggcccaggucucgguca

SEQ ID NO: 2027 - RNA, 25 nt, Homo sapiens
acaggcccaggucucggucagggcc

SEQ ID NO: 2028 - RNA, 25 nt, Homo sapiens
cagggccaggccucccgagagcagc

SEQ ID NO: 2029 - RNA, 25 nt, Homo sapiens
ggccaggccucccgagagcagcagg

SEQ ID NO: 2030 - RNA, 25 nt, Homo sapiens
caggccucccgagagcagcaggagg

SEQ ID NO: 2031 - RNA, 25 nt, Homo sapiens
aggccucccgagagcagcaggagga

SEQ ID NO: 2032 - RNA, 25 nt, Homo sapiens
ucccgagagcagcaggaggagggcu

SEQ ID NO: 2033 - RNA, 25 nt, Homo sapiens
cccgagagcagcaggaggagggcuc

SEQ ID NO: 2034 - RNA, 25 nt, Homo sapiens
ccgagagcagcaggaggagggcucg

SEQ ID NO: 2035 - RNA, 25 nt, Homo sapiens
gcucggggcgccaugacccgcaucu

SEQ ID NO: 2036 - RNA, 25 nt, Homo sapiens
gcgccaugacccgcaucucggccuc

SEQ ID NO: 2037 - RNA, 25 nt, Homo sapiens
cgccaugacccgcaucucggccucu

SEQ ID NO: 2038 - RNA, 25 nt, Homo sapiens
gccaugacccgcaucucggccucug

SEQ ID NO: 2039 - RNA, 25 nt, Homo sapiens
ucggccucuggggagaaugugaguc

SEQ ID NO: 2040 - RNA, 25 nt, Homo sapiens
cggccucuggggagaaugugagucc

SEQ ID NO: 2041 - RNA, 25 nt, Homo sapiens
ccucuggggagaaugugaguccggg

SEQ ID NO: 2042 - RNA, 25 nt, Homo sapiens
cucuggggagaaugugaguccgggu

SEQ ID NO: 2043 - RNA, 25 nt, Homo sapiens
gagaaugugaguccgggugggugac

SEQ ID NO: 2044 - RNA, 25 nt, Homo sapiens
agaaugugaguccgggugggugacu

SEQ ID NO: 2045 - RNA, 25 nt, Homo sapiens
gaaugugaguccgggugggugacug

SEQ ID NO: 2046 - RNA, 25 nt, Homo sapiens
ggugggugacuggggacuuuagaac

SEQ ID NO: 2047 - RNA, 25 nt, Homo sapiens
gugggugacuggggacuuuagaacc

SEQ ID NO: 2048 - RNA, 25 nt, Homo sapiens
acuggggacuuuagaaccgggacug

SEQ ID NO: 2049 - RNA, 25 nt, Homo sapiens
gaaccgggacugcggagacgcugau

SEQ ID NO: 2050 - RNA, 25 nt, Homo sapiens
ugggccugugagugcgggguuggga

SEQ ID NO: 2051 - RNA, 25 nt, Homo sapiens
cugggccugugagugcgggguuggg

SEQ ID NO: 2052 - RNA, 25 nt, Homo sapiens
gaccugggccugugagugcgggguu

SEQ ID NO: 2053 - RNA, 25 nt, Homo sapiens
agaccugggccugugagugcggggu

SEQ ID NO: 2054 - RNA, 25 nt, Homo sapiens
accgagaccugggccugugagugcg

SEQ ID NO: 2055 - RNA, 25 nt, Homo sapiens
gaccgagaccugggccugugagugc

SEQ ID NO: 2056 - RNA, 25 nt, Homo sapiens
ugaccgagaccugggccugugagug

SEQ ID NO: 2057 - RNA, 25 nt, Homo sapiens
ggaggccuggcccugaccgagaccu

SEQ ID NO: 2058 - RNA, 25 nt, Homo sapiens
gggaggccuggcccugaccgagacc

SEQ ID NO: 2059 - RNA, 25 nt, Homo sapiens
cuccuccugcugcucucgggaggcc

SEQ ID NO: 2060 - RNA, 25 nt, Homo sapiens
gagcccuccuccugcugcucucggg

SEQ ID NO: 2061 - RNA, 25 nt, Homo sapiens
cccgagcccuccuccugcugcucuc

SEQ ID NO: 2062 - RNA, 25 nt, Homo sapiens
ccccgagcccuccuccugcugcucu

SEQ ID NO: 2063 - RNA, 25 nt, Homo sapiens
uccccagaggccgagaugcggguca

SEQ ID NO: 2064 - RNA, 25 nt, Homo sapiens
acauucuccccagaggccgagaugc

SEQ ID NO: 2065 - RNA, 25 nt, Homo sapiens
cacauucuccccagaggccgagaug

SEQ ID NO: 2066 - RNA, 25 nt, Homo sapiens
ccacccggacucacauucuccccag

SEQ ID NO: 2067 - RNA, 25 nt, Homo sapiens
guucuaaaguccccagucacccacc

SEQ ID NO: 2068 - RNA, 25 nt, Homo sapiens
aagccaaucagcgucuccgcagucc

SEQ ID NO: 2069 - RNA, 25 nt, Homo sapiens
uuuuauuaugauguuucuccauauu

SEQ ID NO: 2070 - RNA, 25 nt, Homo sapiens
ucuccauauuuggcauugcuguaaa

SEQ ID NO: 2071 - RNA, 25 nt, Homo sapiens
aaauggcuaacauuuacugccaauu

SEQ ID NO: 2072 - RNA, 25 nt, Homo sapiens
uuacugccaauucgguacaaaugug

SEQ ID NO: 2073 - RNA, 25 nt, Homo sapiens
gccaauucgguacaaaugugugguu

SEQ ID NO: 2074 - RNA, 25 nt, Homo sapiens
aauaaaaguuaaacauuuccacaca

SEQ ID NO: 2075 - RNA, 25 nt, Homo sapiens
uuuacagucugacauuucacugcgu

SEQ ID NO: 2076 - RNA, 25 nt, Homo sapiens
aaaacuacaacuuuuauuuuuaaac

SEQ ID NO: 2077 - RNA, 25 nt, Homo sapiens
acuuuuauuuuuaaacaggagucac

SEQ ID NO: 2078 - RNA, 25 nt, Homo sapiens
uauauguaguuaagcaaguuauuug

SEQ ID NO: 2079 - RNA, 25 nt, Homo sapiens
auguaguuaagcaaguuauuugagg

SEQ ID NO: 2080 - RNA, 25 nt, Homo sapiens
uguaguuaagcaaguuauuugagga

SEQ ID NO: 2081 - RNA, 25 nt, Homo sapiens
agaagcaaauccuuuccugaaaacc

SEQ ID NO: 2082 - RNA, 25 nt, Homo sapiens
uuccugaaaaccuggucacuaaucc

SEQ ID NO: 2083 - RNA, 25 nt, Homo sapiens
uccugaaaaccuggucacuaauccu

SEQ ID NO: 2084 - RNA, 25 nt, Homo sapiens
ugaaaaccuggucacuaauccuggg

SEQ ID NO: 2085 - RNA, 25 nt, Homo sapiens
ccuggucacuaauccuggguggacc

SEQ ID NO: 2086 - RNA, 25 nt, Homo sapiens
uggaccagguugcuugaaaauaguc

SEQ ID NO: 2087 - RNA, 25 nt, Homo sapiens
ggaccagguugcuugaaaauagucu

SEQ ID NO: 2088 - RNA, 25 nt, Homo sapiens
ugggaaauuacgaaacuccacccaa

SEQ ID NO: 2089 - RNA, 25 nt, Homo sapiens
gggaaauuacgaaacuccacccaaa

SEQ ID NO: 2090 - RNA, 25 nt, Homo sapiens
aacacauucaccuacagcuacaguc

SEQ ID NO: 2091 - RNA, 25 nt, Homo sapiens
acacauucaccuacagcuacaguca

SEQ ID NO: 2092 - RNA, 25 nt, Homo sapiens
acagucagggagugaccagccaaga

SEQ ID NO: 2093 - RNA, 25 nt, Homo sapiens
ccagccaagauggaaaucucacuga

SEQ ID NO: 2094 - RNA, 25 nt, Homo sapiens
auggaaaucucacugaaggcuacca

SEQ ID NO: 2095 - RNA, 25 nt, Homo sapiens
aucucacugaaggcuaccaugguuc

SEQ ID NO: 2096 - RNA, 25 nt, Homo sapiens
uuguauaacaauauuuuucauucca

SEQ ID NO: 2097 - RNA, 25 nt, Homo sapiens
uucauuccauggugauguaguuuuc

SEQ ID NO: 2098 - RNA, 25 nt, Homo sapiens
ucauuccauggugauguaguuuuca

SEQ ID NO: 2099 - RNA, 25 nt, Homo sapiens
ugauguaguuuucaggguuuuuaaa

SEQ ID NO: 2100 - RNA, 25 nt, Homo sapiens
gauguaguuuucaggguuuuuaaaa

SEQ ID NO: 2101 - RNA, 25 nt, Homo sapiens
aaagggaacuaaaauuaugagacuu

SEQ ID NO: 2102 - RNA, 25 nt, Homo sapiens
uaaaauuaugagacuuaggugaaac

SEQ ID NO: 2103 - RNA, 25 nt, Homo sapiens
auugcucccugccucugaauucuga

SEQ ID NO: 2104 - RNA, 25 nt, Homo sapiens
uugcucccugccucugaauucugaa

SEQ ID NO: 2105 - RNA, 25 nt, Homo sapiens
cugccucugaauucugaagggagcg

SEQ ID NO: 2106 - RNA, 25 nt, Homo sapiens
cugaagggagcguggcuuuccuuca

SEQ ID NO: 2107 - RNA, 25 nt, Homo sapiens
acacaaaucauguuaguuuuccuuu

SEQ ID NO: 2108 - RNA, 25 nt, Homo sapiens
cacaaaucauguuaguuuuccuuuu

SEQ ID NO: 2109 - RNA, 25 nt, Homo sapiens
acaaaucauguuaguuuuccuuuug

SEQ ID NO: 2110 - RNA, 25 nt, Homo sapiens
aaucauguuaguuuuccuuuugggg

SEQ ID NO: 2111 - RNA, 25 nt, Homo sapiens
guuaguuuuccuuuugggguggcca

SEQ ID NO: 2112 - RNA, 25 nt, Homo sapiens
ggccaagguuuccucccauaguuuu

SEQ ID NO: 2113 - RNA, 25 nt, Homo sapiens
guuuccucccauaguuuuaggcauu

SEQ ID NO: 2114 - RNA, 25 nt, Homo sapiens
ccuacaaacacuaaaaauacuuuuc

SEQ ID NO: 2115 - RNA, 25 nt, Homo sapiens
gaaguuacuacaaacuucaacaguu

SEQ ID NO: 2116 - RNA, 25 nt, Homo sapiens
aaguuacuacaaacuucaacaguuu

SEQ ID NO: 2117 - RNA, 25 nt, Homo sapiens
uacuacaaacuucaacaguuugggu

SEQ ID NO: 2118 - RNA, 25 nt, Homo sapiens
acuacaaacuucaacaguuuggguu

SEQ ID NO: 2119 - RNA, 25 nt, Homo sapiens
caaacuucaacaguuuggguuggga

SEQ ID NO: 2120 - RNA, 25 nt, Homo sapiens
ugggauggccagauaacacauacau

SEQ ID NO: 2121 - RNA, 25 nt, Homo sapiens
uuucuuuucccccacguauccuaaa

SEQ ID NO: 2122 - RNA, 25 nt, Homo sapiens
uucuuuucccccacguauccuaaaa

SEQ ID NO: 2123 - RNA, 25 nt, Homo sapiens
ucuauuuuuugagcgccaagauugu

SEQ ID NO: 2124 - RNA, 25 nt, Homo sapiens
cuauuuuuugagcgccaagauuguu

SEQ ID NO: 2125 - RNA, 25 nt, Homo sapiens
agauuaaugugugagaugugcuuuc

SEQ ID NO: 2126 - RNA, 25 nt, Homo sapiens
guuuuaaccacauaacauucuauaa

SEQ ID NO: 2127 - RNA, 25 nt, Homo sapiens
auaagaauauucaagcaguuuucuu

SEQ ID NO: 2128 - RNA, 25 nt, Homo sapiens
cuuaggcaccaaaaauuuauccagc

SEQ ID NO: 2129 - RNA, 25 nt, Homo sapiens
uuaggcaccaaaaauuuauccagcc

SEQ ID NO: 2130 - RNA, 25 nt, Homo sapiens
aacaaaaacauguccucauuuuauu

SEQ ID NO: 2131 - RNA, 25 nt, Homo sapiens
uuauuuggaaauaaacucuuguugu

SEQ ID NO: 2132 - RNA, 25 nt, Homo sapiens
aauaaacucuuguuguaggauagaa

SEQ ID NO: 2133 - RNA, 25 nt, Homo sapiens
ggauagaaaggaauuaguguauuau

SEQ ID NO: 2134 - RNA, 25 nt, Homo sapiens
agauucugcacuauuuacauauugc

SEQ ID NO: 2135 - RNA, 25 nt, Homo sapiens
gaagcuucuguugucauucaacugc

SEQ ID NO: 2136 - RNA, 25 nt, Homo sapiens
aagcuucuguugucauucaacugcu

SEQ ID NO: 2137 - RNA, 25 nt, Homo sapiens
agcuucuguugucauucaacugcug

SEQ ID NO: 2138 - RNA, 25 nt, Homo sapiens
gcuucuguugucauucaacugcugg

SEQ ID NO: 2139 - RNA, 25 nt, Homo sapiens
ucuguugucauucaacugcuggggg

SEQ ID NO: 2140 - RNA, 25 nt, Homo sapiens
cuguugucauucaacugcuggggga

SEQ ID NO: 2141 - RNA, 25 nt, Homo sapiens
uaugugaaaguaacccgcuauuaga

SEQ ID NO: 2142 - RNA, 25 nt, Homo sapiens
aacccgcuauuagauggugccuuua

SEQ ID NO: 2143 - RNA, 25 nt, Homo sapiens
uacauacuuuacauacuuuagugca

SEQ ID NO: 2144 - RNA, 25 nt, Homo sapiens
acauacuuuacauacuuuagugcaa

SEQ ID NO: 2145 - RNA, 25 nt, Homo sapiens
cauacuuuacauacuuuagugcaag

SEQ ID NO: 2146 - RNA, 25 nt, Homo sapiens
aaaccugcgcugacagacucacugu

SEQ ID NO: 2147 - RNA, 25 nt, Homo sapiens
ugacagacucacuguuggaaugaga

SEQ ID NO: 2148 - RNA, 25 nt, Homo sapiens
gacagacucacuguuggaaugagaa

SEQ ID NO: 2149 - RNA, 25 nt, Homo sapiens
agacucacuguuggaaugagaaggg

SEQ ID NO: 2150 - RNA, 25 nt, Homo sapiens
guuggaaugagaaggguggucagaa

SEQ ID NO: 2151 - RNA, 25 nt, Homo sapiens
uuggaaugagaaggguggucagaau

SEQ ID NO: 2152 - RNA, 25 nt, Homo sapiens
gaaugagaaggguggucagaauggg

SEQ ID NO: 2153 - RNA, 25 nt, Homo sapiens
gaaggguggucagaaugggaggcag

SEQ ID NO: 2154 - RNA, 25 nt, Homo sapiens
aggauaacuuccucuguaaucucac

SEQ ID NO: 2155 - RNA, 25 nt, Homo sapiens
ggauaacuuccucuguaaucucacu

SEQ ID NO: 2156 - RNA, 25 nt, Homo sapiens
agccucagcaaccuucacugcacac

SEQ ID NO: 2157 - RNA, 25 nt, Homo sapiens
cccucuuccccuagagcaaacuguu

SEQ ID NO: 2158 - RNA, 25 nt, Homo sapiens
ugcauguacaaacuauaaaucauau

SEQ ID NO: 2159 - RNA, 25 nt, Homo sapiens
ucaguuuucuauuacacaaauaauu

SEQ ID NO: 2160 - RNA, 25 nt, Homo sapiens
ccuugaauagaaaucaaauuucuug

SEQ ID NO: 2161 - RNA, 25 nt, Homo sapiens
guuaaguuuugaguuuacagaaagu

SEQ ID NO: 2162 - RNA, 25 nt, Homo sapiens
guuuugaguuuacagaaaguuggua

SEQ ID NO: 2163 - RNA, 25 nt, Homo sapiens
gaaaguugguaaggugcacacagaa

SEQ ID NO: 2164 - RNA, 25 nt, Homo sapiens
aaaguugguaaggugcacacagaaa

SEQ ID NO: 2165 - RNA, 25 nt, Homo sapiens
aauuuucaacagugaagaaauucac

SEQ ID NO: 2166 - RNA, 25 nt, Homo sapiens
uucacaggacuuguguuaaacucua

SEQ ID NO: 2167 - RNA, 25 nt, Homo sapiens
uguguuaaacucuauggcacacauu

SEQ ID NO: 2168 - RNA, 25 nt, Homo sapiens
guguuaaacucuauggcacacauua

SEQ ID NO: 2169 - RNA, 25 nt, Homo sapiens
uuagggauguguaguuuuacaaaca

SEQ ID NO: 2170 - RNA, 25 nt, Homo sapiens
aguagcugagcuuuccuguaccauc

SEQ ID NO: 2171 - RNA, 25 nt, Homo sapiens
guaccaucaggaaagauuaaccaau

SEQ ID NO: 2172 - RNA, 25 nt, Homo sapiens
gaaagauuaaccaauuggugacaga

SEQ ID NO: 2173 - RNA, 25 nt, Homo sapiens
aaagauuaaccaauuggugacagau

SEQ ID NO: 2174 - RNA, 25 nt, Homo sapiens
uuggugacagaugggaaugugaaaa

SEQ ID NO: 2175 - RNA, 25 nt, Homo sapiens
uggugacagaugggaaugugaaaau

SEQ ID NO: 2176 - RNA, 25 nt, Homo sapiens
uuugccauauuagagauuuaguuuu

SEQ ID NO: 2177 - RNA, 25 nt, Homo sapiens
uugccauauuagagauuuaguuuuu

SEQ ID NO: 2178 - RNA, 25 nt, Homo sapiens
uaguuuuuggguaaaguuuagugag

SEQ ID NO: 2179 - RNA, 25 nt, Homo sapiens
aaaagucucucagcuguguuacagc

SEQ ID NO: 2180 - RNA, 25 nt, Homo sapiens
cucagcuguguuacagcugguuauc

SEQ ID NO: 2181 - RNA, 25 nt, Homo sapiens
aagaaguuauacaaacuacuucaaa

SEQ ID NO: 2182 - RNA, 25 nt, Homo sapiens
cuugccauauagccauugcaaaaau

SEQ ID NO: 2183 - RNA, 25 nt, Homo sapiens
uugccauauagccauugcaaaaaua

SEQ ID NO: 2184 - RNA, 25 nt, Homo sapiens
auagccauugcaaaaauagggcguu

SEQ ID NO: 2185 - RNA, 25 nt, Homo sapiens
caaaaauagggcguuagguacagac

SEQ ID NO: 2186 - RNA, 25 nt, Homo sapiens
aaaaauagggcguuagguacagaca

SEQ ID NO: 2187 - RNA, 25 nt, Homo sapiens
ggcguuagguacagacagggccucu

SEQ ID NO: 2188 - RNA, 25 nt, Homo sapiens
aaccaucauccacaguuuacccagc

SEQ ID NO: 2189 - RNA, 25 nt, Homo sapiens
auccacaguuuacccagcaggucac

SEQ ID NO: 2190 - RNA, 25 nt, Homo sapiens
aguuuacccagcaggucacuggacu

SEQ ID NO: 2191 - RNA, 25 nt, Homo sapiens
cuggacuaggugcucuauaccaguu

SEQ ID NO: 2192 - RNA, 25 nt, Homo sapiens
uuuuuuuuuuuuuugacaagaauac

SEQ ID NO: 2193 - RNA, 25 nt, Homo sapiens
uacuggagauuugagucaauuuuug

SEQ ID NO: 2194 - RNA, 25 nt, Homo sapiens
ggucuucugauagcuaagugccauc

SEQ ID NO: 2195 - RNA, 25 nt, Homo sapiens
gauugauuaauguuuagaguuuauu

SEQ ID NO: 2196 - RNA, 25 nt, Homo sapiens
auugauuaauguuuagaguuuauuu

SEQ ID NO: 2197 - RNA, 25 nt, Homo sapiens
agcaagcguaguucacuaaauauaa

SEQ ID NO: 2198 - RNA, 25 nt, Homo sapiens
aaaaccagacaguaauagcuauaaa

SEQ ID NO: 2199 - RNA, 25 nt, Homo sapiens
gauauacacuuguaaacuuuuuuuc

SEQ ID NO: 2200 - RNA, 25 nt, Homo sapiens
aucaaaaaugcuauccuaacuauac

SEQ ID NO: 2201 - RNA, 25 nt, Homo sapiens
ucaaaaaugcuauccuaacuauaca

SEQ ID NO: 2202 - RNA, 25 nt, Homo sapiens
caaaaaugcuauccuaacuauacag

SEQ ID NO: 2203 - RNA, 25 nt, Homo sapiens
aaaaaugcuauccuaacuauacagg

SEQ ID NO: 2204 - RNA, 25 nt, Homo sapiens
aaaaugcuauccuaacuauacaggg

SEQ ID NO: 2205 - RNA, 25 nt, Homo sapiens
aaaugcuauccuaacuauacagggg

SEQ ID NO: 2206 - RNA, 25 nt, Homo sapiens
aaugcuauccuaacuauacaggggg

SEQ ID NO: 2207 - RNA, 25 nt, Homo sapiens
aagagaaaguucaucacacagacuu

SEQ ID NO: 2208 - RNA, 25 nt, Homo sapiens
agagaaaguucaucacacagacuuu

SEQ ID NO: 2209 - RNA, 25 nt, Homo sapiens
aguucaucacacagacuuugggcac

SEQ ID NO: 2210 - RNA, 25 nt, Homo sapiens
ucaucacacagacuuugggcacugg

SEQ ID NO: 2211 - RNA, 25 nt, Homo sapiens
cacagacuuugggcacuggugguuu

SEQ ID NO: 2212 - RNA, 25 nt, Homo sapiens
uuuaggugccauccuucuuugacug

SEQ ID NO: 2213 - RNA, 25 nt, Homo sapiens
cuguggagauuacguccacauauua

SEQ ID NO: 2214 - RNA, 25 nt, Homo sapiens
uccacauauuaagguuucuaauuuc

SEQ ID NO: 2215 - RNA, 25 nt, Homo sapiens
ccacauauuaagguuucuaauuucu

SEQ ID NO: 2216 - RNA, 25 nt, Homo sapiens
cucaacugcuucuguugccaagucu

SEQ ID NO: 2217 - RNA, 25 nt, Homo sapiens
aaaaauaaaacaacaaaaccucuac

SEQ ID NO: 2218 - RNA, 25 nt, Homo sapiens
aaagcuauuaauucgacuuucuuua

SEQ ID NO: 2219 - RNA, 25 nt, Homo sapiens
uucuuuaaggcaaccauucuuauua

SEQ ID NO: 2220 - RNA, 25 nt, Homo sapiens
uuuugauauuuccauuugaauauuu

SEQ ID NO: 2221 - RNA, 25 nt, Homo sapiens
ccauuugaauauuuugguaucugau

SEQ ID NO: 2222 - RNA, 25 nt, Homo sapiens
uuggugaugauuucagcuaacaucu

SEQ ID NO: 2223 - RNA, 25 nt, Homo sapiens
uggugaugauuucagcuaacaucuc

SEQ ID NO: 2224 - RNA, 25 nt, Homo sapiens
ggugaugauuucagcuaacaucucg

SEQ ID NO: 2225 - RNA, 25 nt, Homo sapiens
aacaucucggggaauucaauacuca

SEQ ID NO: 2226 - RNA, 25 nt, Homo sapiens
acucauggucuuauccaaaaauguu

SEQ ID NO: 2227 - RNA, 25 nt, Homo sapiens
caaaaauguuuggaagcaauaguua

SEQ ID NO: 2228 - RNA, 25 nt, Homo sapiens
uuucaaccaccugcaagagaagaua

SEQ ID NO: 2229 - RNA, 25 nt, Homo sapiens
uagccauuuacagcaaugccaaaua

SEQ ID NO: 2230 - RNA, 25 nt, Homo sapiens
accaaaccacacauuuguaccgaau

SEQ ID NO: 2231 - RNA, 25 nt, Homo sapiens
auuuuuucauuuaaauuugcuguuc

SEQ ID NO: 2232 - RNA, 25 nt, Homo sapiens
aaaugucagacuguaaaaccuugug

SEQ ID NO: 2233 - RNA, 25 nt, Homo sapiens
ggacaaaucuauauuauacugugua

SEQ ID NO: 2234 - RNA, 25 nt, Homo sapiens
uuuguauauuaaaugcuauauaaug

SEQ ID NO: 2235 - RNA, 25 nt, Homo sapiens
uuuuguauauuaaaugcuauauaau

SEQ ID NO: 2236 - RNA, 25 nt, Homo sapiens
auuuuguauauuaaaugcuauauaa

SEQ ID NO: 2237 - RNA, 25 nt, Homo sapiens
ugaaaggauuuuauuuucugaugaa

SEQ ID NO: 2238 - RNA, 25 nt, Homo sapiens
ugcuucucucuagaaaaugucugaa

SEQ ID NO: 2239 - RNA, 25 nt, Homo sapiens
ggauuagugaccagguuuucaggaa

SEQ ID NO: 2240 - RNA, 25 nt, Homo sapiens
acccaggauuagugaccagguuuuc

SEQ ID NO: 2241 - RNA, 25 nt, Homo sapiens
ccugguccacccaggauuagugacc

SEQ ID NO: 2242 - RNA, 25 nt, Homo sapiens
uauuuucaagcaaccugguccaccc

SEQ ID NO: 2243 - RNA, 25 nt, Homo sapiens
uuucccagacuauuuucaagcaacc

SEQ ID NO: 2244 - RNA, 25 nt, Homo sapiens
aggaggacacuuuaaacccuuuggg

SEQ ID NO: 2245 - RNA, 25 nt, Homo sapiens
guaaggaggacacuuuaaacccuuu

SEQ ID NO: 2246 - RNA, 25 nt, Homo sapiens
uguaaggaggacacuuuaaacccuu

SEQ ID NO: 2247 - RNA, 25 nt, Homo sapiens
ucagaagggaaauaaaaguguaagg

SEQ ID NO: 2248 - RNA, 25 nt, Homo sapiens
gugucagaagggaaauaaaagugua

SEQ ID NO: 2249 - RNA, 25 nt, Homo sapiens
acacacagacguuuuagugucagaa

SEQ ID NO: 2250 - RNA, 25 nt, Homo sapiens
cacacacagacguuuuagugucaga

SEQ ID NO: 2251 - RNA, 25 nt, Homo sapiens
cuggucacucccugacuguagcugu

SEQ ID NO: 2252 - RNA, 25 nt, Homo sapiens
ccuucagugagauuuccaucuuggc

SEQ ID NO: 2253 - RNA, 25 nt, Homo sapiens
guagccuucagugagauuuccaucu

SEQ ID NO: 2254 - RNA, 25 nt, Homo sapiens
uugaucugucaaacuuccagaacca

SEQ ID NO: 2255 - RNA, 25 nt, Homo sapiens
aaaaacccugaaaacuacaucacca

SEQ ID NO: 2256 - RNA, 25 nt, Homo sapiens
acgcucccuucagaauucagaggca

SEQ ID NO: 2257 - RNA, 25 nt, Homo sapiens
cacgcucccuucagaauucagaggc

SEQ ID NO: 2258 - RNA, 25 nt, Homo sapiens
aagccacgcucccuucagaauucag

SEQ ID NO: 2259 - RNA, 25 nt, Homo sapiens
gggaugagcucugggcaugccauga

SEQ ID NO: 2260 - RNA, 25 nt, Homo sapiens
ggauaauuagcaugggaugagcucu

SEQ ID NO: 2261 - RNA, 25 nt, Homo sapiens
uggauaauuagcaugggaugagcuc

SEQ ID NO: 2262 - RNA, 25 nt, Homo sapiens
cuaugaagugcuggauaauuagcau

SEQ ID NO: 2263 - RNA, 25 nt, Homo sapiens
ucuaugaagugcuggauaauuagca

SEQ ID NO: 2264 - RNA, 25 nt, Homo sapiens
aacaugauuugugucuaugaagugc

SEQ ID NO: 2265 - RNA, 25 nt, Homo sapiens
gggaggaaaccuuggccaccccaaa

SEQ ID NO: 2266 - RNA, 25 nt, Homo sapiens
ugccuaaaacuaugggaggaaaccu

SEQ ID NO: 2267 - RNA, 25 nt, Homo sapiens
auauccaaaugccuaaaacuauggg

SEQ ID NO: 2268 - RNA, 25 nt, Homo sapiens
uauauauccaaaugccuaaaacuau

SEQ ID NO: 2269 - RNA, 25 nt, Homo sapiens
auauauauccaaaugccuaaaacua

SEQ ID NO: 2270 - RNA, 25 nt, Homo sapiens
aggcacuuaggacauaacacuuuug

SEQ ID NO: 2271 - RNA, 25 nt, Homo sapiens
gaggcacuuaggacauaacacuuuu

SEQ ID NO: 2272 - RNA, 25 nt, Homo sapiens
ugaggcacuuaggacauaacacuuu

SEQ ID NO: 2273 - RNA, 25 nt, Homo sapiens
cuauacaagcagaacugaggcacuu

SEQ ID NO: 2274 - RNA, 25 nt, Homo sapiens
gugggauacuauacaagcagaacug

SEQ ID NO: 2275 - RNA, 25 nt, Homo sapiens
uuuuuaguguuuguagguauucugu

SEQ ID NO: 2276 - RNA, 25 nt, Homo sapiens
auuuuuaguguuuguagguauucug

SEQ ID NO: 2277 - RNA, 25 nt, Homo sapiens
ccugaaaaguauuuuuaguguuugu

SEQ ID NO: 2278 - RNA, 25 nt, Homo sapiens
aguuuguaguaacuucagugagagu

SEQ ID NO: 2279 - RNA, 25 nt, Homo sapiens
auuuauuuccuauguauguguuauc

SEQ ID NO: 2280 - RNA, 25 nt, Homo sapiens
aauuguggauuuaagugcuauaugg

SEQ ID NO: 2281 - RNA, 25 nt, Homo sapiens
uuuaauuguggauuuaagugcuaua

SEQ ID NO: 2282 - RNA, 25 nt, Homo sapiens
aagucaucuuaauuauguuuaauug

SEQ ID NO: 2283 - RNA, 25 nt, Homo sapiens
agcugugcccuuuuaggauacgugg

SEQ ID NO: 2284 - RNA, 25 nt, Homo sapiens
aagcugugcccuuuuaggauacgug

SEQ ID NO: 2285 - RNA, 25 nt, Homo sapiens
gaagcugugcccuuuuaggauacgu

SEQ ID NO: 2286 - RNA, 25 nt, Homo sapiens
agaagcugugcccuuuuaggauacg

SEQ ID NO: 2287 - RNA, 25 nt, Homo sapiens
augggaaaagaagcugugcccuuuu

SEQ ID NO: 2288 - RNA, 25 nt, Homo sapiens
aacuauaggaggcuuuucauuaaau

SEQ ID NO: 2289 - RNA, 25 nt, Homo sapiens
caacuauaggaggcuuuucauuaaa

SEQ ID NO: 2290 - RNA, 25 nt, Homo sapiens
acugaugcucaucgacaacuauagg

SEQ ID NO: 2291 - RNA, 25 nt, Homo sapiens
ucaacugaugcucaucgacaacuau

SEQ ID NO: 2292 - RNA, 25 nt, Homo sapiens
aaucugauuuucaucccaacaaucu

SEQ ID NO: 2293 - RNA, 25 nt, Homo sapiens
uaucauuccuuuauagaauguuaug

SEQ ID NO: 2294 - RNA, 25 nt, Homo sapiens
uguguaacccggcuggauaaauuuu

SEQ ID NO: 2295 - RNA, 25 nt, Homo sapiens
auuuuaagaugguguguaacccggc

SEQ ID NO: 2296 - RNA, 25 nt, Homo sapiens
uaauauuuuaagaugguguguaacc

SEQ ID NO: 2297 - RNA, 25 nt, Homo sapiens
uaaaagggaauguaauauuuuaaga

SEQ ID NO: 2298 - RNA, 25 nt, Homo sapiens
uuugcuuuuugaaugcucucuaaaa

SEQ ID NO: 2299 - RNA, 25 nt, Homo sapiens
auuugcuuuuugaaugcucucuaaa

SEQ ID NO: 2300 - RNA, 25 nt, Homo sapiens
auguuauuuguuauuuucaguauuu

SEQ ID NO: 2301 - RNA, 25 nt, Homo sapiens
caagaguuuauuuccaaauaaaaug

SEQ ID NO: 2302 - RNA, 25 nt, Homo sapiens
auauguaaauagugcagaaucucau

SEQ ID NO: 2303 - RNA, 25 nt, Homo sapiens
agaaguuuggcaauaguuugcauag

SEQ ID NO: 2304 - RNA, 25 nt, Homo sapiens
aaugacaacagaagcuucagaaguu

SEQ ID NO: 2305 - RNA, 25 nt, Homo sapiens
auccuuaaaggcaccaucuaauagc

SEQ ID NO: 2306 - RNA, 25 nt, Homo sapiens
cauccuuaaaggcaccaucuaauag

SEQ ID NO: 2307 - RNA, 25 nt, Homo sapiens
aggaagguggugcuuacauccuuaa

SEQ ID NO: 2308 - RNA, 25 nt, Homo sapiens
aguauguaaacaggagacaggaagg

SEQ ID NO: 2309 - RNA, 25 nt, Homo sapiens
uaaaguauguaaacaggagacagga

SEQ ID NO: 2310 - RNA, 25 nt, Homo sapiens
uauguaaaguauguaaacaggagac

SEQ ID NO: 2311 - RNA, 25 nt, Homo sapiens
acuaaaguauguaaaguauguaaac

SEQ ID NO: 2312 - RNA, 25 nt, Homo sapiens
auuccaacagugagucugucagcgc

SEQ ID NO: 2313 - RNA, 25 nt, Homo sapiens
aggcucugacccagugagauuacag

SEQ ID NO: 2314 - RNA, 25 nt, Homo sapiens
guccugugugcagugaagguugcug

SEQ ID NO: 2315 - RNA, 25 nt, Homo sapiens
uggagacugguccugugugcaguga

SEQ ID NO: 2316 - RNA, 25 nt, Homo sapiens
ucuaggggaagagggagauggagac

SEQ ID NO: 2317 - RNA, 25 nt, Homo sapiens
aguuugcucuaggggaagagggaga

SEQ ID NO: 2318 - RNA, 25 nt, Homo sapiens
ccaaacaguuugcucuaggggaaga

SEQ ID NO: 2319 - RNA, 25 nt, Homo sapiens
accaaacaguuugcucuaggggaag

SEQ ID NO: 2320 - RNA, 25 nt, Homo sapiens
ucagaaaccaaacaguuugcucuag

SEQ ID NO: 2321 - RNA, 25 nt, Homo sapiens
cucagaaaccaaacaguuugcucua

SEQ ID NO: 2322 - RNA, 25 nt, Homo sapiens
ucucagaaaccaaacaguuugcucu

SEQ ID NO: 2323 - RNA, 25 nt, Homo sapiens
guacaugcauucauacaggcagcga

SEQ ID NO: 2324 - RNA, 25 nt, Homo sapiens
uuauaguuuguacaugcauucauac

SEQ ID NO: 2325 - RNA, 25 nt, Homo sapiens
uuuguaggggucaaagaaaugcuga

SEQ ID NO: 2326 - RNA, 25 nt, Homo sapiens
augacauguuauauauuuuuuguag

SEQ ID NO: 2327 - RNA, 25 nt, Homo sapiens
caugacauguuauauauuuuuugua

SEQ ID NO: 2328 - RNA, 25 nt, Homo sapiens
ucaugacauguuauauauuuuuugu

SEQ ID NO: 2329 - RNA, 25 nt, Homo sapiens
ccauaacacuaaucugggaagggaa

SEQ ID NO: 2330 - RNA, 25 nt, Homo sapiens
accauaacacuaaucugggaaggga

SEQ ID NO: 2331 - RNA, 25 nt, Homo sapiens
uauaaccauaacacuaaucugggaa

SEQ ID NO: 2332 - RNA, 25 nt, Homo sapiens
guauaaccauaacacuaaucuggga

SEQ ID NO: 2333 - RNA, 25 nt, Homo sapiens
uauaguauaaccauaacacuaaucu

SEQ ID NO: 2334 - RNA, 25 nt, Homo sapiens
auauaguauaaccauaacacuaauc

SEQ ID NO: 2335 - RNA, 25 nt, Homo sapiens
aacugaaaaucuaauauuaaaaaua

SEQ ID NO: 2336 - RNA, 25 nt, Homo sapiens
caagaaauuugauuucuauucaagg

SEQ ID NO: 2337 - RNA, 25 nt, Homo sapiens
ccacaagaaauuugauuucuauuca

SEQ ID NO: 2338 - RNA, 25 nt, Homo sapiens
auugguuaaucuuuccugaugguac

SEQ ID NO: 2339 - RNA, 25 nt, Homo sapiens
ucaccaauugguuaaucuuuccuga

SEQ ID NO: 2340 - RNA, 25 nt, Homo sapiens
uuucacauucccaucugucaccaau

SEQ ID NO: 2341 - RNA, 25 nt, Homo sapiens
aacuaaaucucuaauauggcaaaaa

SEQ ID NO: 2342 - RNA, 25 nt, Homo sapiens
uuacccaaaaacuaaaucucuaaua

SEQ ID NO: 2343 - RNA, 25 nt, Homo sapiens
aaagcugguaaacuauuugucuuuc

SEQ ID NO: 2344 - RNA, 25 nt, Homo sapiens
ugcaauggcuauauggcaagaaagc

SEQ ID NO: 2345 - RNA, 25 nt, Homo sapiens
acgcccuauuuuugcaauggcuaua

SEQ ID NO: 2346 - RNA, 25 nt, Homo sapiens
uguaccuaacgcccuauuuuugcaa

SEQ ID NO: 2347 - RNA, 25 nt, Homo sapiens
acuaauuuaaaaaauaacuaccaag

SEQ ID NO: 2348 - RNA, 25 nt, Homo sapiens
gaccugcuggguaaacuguggauga

SEQ ID NO: 2349 - RNA, 25 nt, Homo sapiens
guccagugaccugcuggguaaacug

SEQ ID NO: 2350 - RNA, 25 nt, Homo sapiens
agagcaccuaguccagugaccugcu

SEQ ID NO: 2351 - RNA, 25 nt, Homo sapiens
uagagcaccuaguccagugaccugc

SEQ ID NO: 2352 - RNA, 25 nt, Homo sapiens
gguugugcaaauuaacaguccuaac

SEQ ID NO: 2353 - RNA, 25 nt, Homo sapiens
uaucugcuucaguggagaauuauau

SEQ ID NO: 2354 - RNA, 25 nt, Homo sapiens
cauauuuuguauauaucugcuucag

SEQ ID NO: 2355 - RNA, 25 nt, Homo sapiens
aaauggguuggugcuucuaaccuga

SEQ ID NO: 2356 - RNA, 25 nt, Homo sapiens
aucaaucaucugugugaaaaugggu

SEQ ID NO: 2357 - RNA, 25 nt, Homo sapiens
auuaaucaaucaucugugugaaaau

SEQ ID NO: 2358 - RNA, 25 nt, Homo sapiens
cauuaaucaaucaucugugugaaaa

SEQ ID NO: 2359 - RNA, 25 nt, Homo sapiens
aaguuauuguacagcuguuuaagau

SEQ ID NO: 2360 - RNA, 25 nt, Homo sapiens
caaguuauuguacagcuguuuaaga

SEQ ID NO: 2361 - RNA, 25 nt, Homo sapiens
ugugccuuuuauagcuauuacuguc

SEQ ID NO: 2362 - RNA, 25 nt, Homo sapiens
aaguuuacaaguguauaucagaaaa

SEQ ID NO: 2363 - RNA, 25 nt, Homo sapiens
aaaguuuacaaguguauaucagaaa

SEQ ID NO: 2364 - RNA, 25 nt, Homo sapiens
uaggauagcauuuuugauuuaugca

SEQ ID NO: 2365 - RNA, 25 nt, Homo sapiens
ugguguauccccccccuguauaguu

SEQ ID NO: 2366 - RNA, 25 nt, Homo sapiens
ggaugaaauuuucuagacuuucugu

SEQ ID NO: 2367 - RNA, 25 nt, Homo sapiens
cuucauacuuuuuuucacaguuggc

SEQ ID NO: 2368 - RNA, 25 nt, Homo sapiens
uucucuucauacuuuuuuucacagu

SEQ ID NO: 2369 - RNA, 25 nt, Homo sapiens
cguaaucuccacagucaaagaagga

SEQ ID NO: 2370 - RNA, 25 nt, Homo sapiens
uggacguaaucuccacagucaaaga

SEQ ID NO: 2371 - RNA, 25 nt, Homo sapiens
cccagaaauuagaaaccuuaauaug

SEQ ID NO: 2372 - RNA, 25 nt, Homo sapiens
cacuuuucagugaugggagaguaga

SEQ ID NO: 2373 - RNA, 25 nt, Homo sapiens
ugagucgucaucacuuuucagugau

SEQ ID NO: 2374 - RNA, 25 nt, Homo sapiens
uugagucgucaucacuuuucaguga

SEQ ID NO: 2375 - RNA, 25 nt, Homo sapiens
augugguuuauagagggccaagacu

SEQ ID NO: 2376 - RNA, 25 nt, Homo sapiens
auacgcacuacaugugguuuauaga

SEQ ID NO: 2377 - RNA, 25 nt, Homo sapiens
aauacgcacuacaugugguuuauag

SEQ ID NO: 2378 - RNA, 25 nt, Homo sapiens
uuuuguuuuaaauacgcacuacaug

SEQ ID NO: 2379 - RNA, 25 nt, Homo sapiens
uauaaacuaucaguuuguccuguag

SEQ ID NO: 2380 - RNA, 25 nt, Homo sapiens
ucaaaagugacugccuuaauaagaa

SEQ ID NO: 2381 - RNA, 25 nt, Homo sapiens
ccaaucagauaccaaaauauucaaa

SEQ ID NO: 2382 - RNA, 25 nt, Homo sapiens
cuuaacuauugcuuccaaacauuuu

SEQ ID NO: 2383 - RNA, 25 nt, Homo sapiens
ucauuaccauaucuucucuugcagg

SEQ ID NO: 2384 - RNA, 25 nt, Homo sapiens
caguugauaaaaccgcugccaguuc

SEQ ID NO: 2385 - RNA, 25 nt, Homo sapiens
ugauaaaaccgcugccaguucuggc

SEQ ID NO: 2386 - RNA, 25 nt, Homo sapiens
cuggaguuuccuucccucuugacaa

SEQ ID NO: 2387 - RNA, 25 nt, Homo sapiens
auggcuuuuccuagcucuuugaugu

SEQ ID NO: 2388 - RNA, 25 nt, Homo sapiens
cauucuaauuucaucaaauagcucu

SEQ ID NO: 2389 - RNA, 25 nt, Homo sapiens
gcucuuggcucuucagaccguccuu

SEQ ID NO: 2390 - RNA, 25 nt, Homo sapiens
cuucagaccguccuuaggaacuaaa

SEQ ID NO: 2391 - RNA, 25 nt, Homo sapiens
cgguuuuaucaacugacaaaacucu

SEQ ID NO: 2392 - RNA, 25 nt, Homo sapiens
aggaaacuccagccagaacuggcag

SEQ ID NO: 2393 - RNA, 25 nt, Homo sapiens
gagggaaggaaacuccagccagaac

SEQ ID NO: 2394 - RNA, 25 nt, Homo sapiens
uaggaaaagccauugucaagaggga

SEQ ID NO: 2395 - RNA, 25 nt, Homo sapiens
gagcuaggaaaagccauugucaaga

SEQ ID NO: 2396 - RNA, 25 nt, Homo sapiens
agagcuaggaaaagccauugucaag

SEQ ID NO: 2397 - RNA, 25 nt, Homo sapiens
uuagaaugaccuacaucaaagagcu

SEQ ID NO: 2398 - RNA, 25 nt, Homo sapiens
aucuuaaccuuuuaguuccuaagga

SEQ ID NO: 2399 - RNA, 25 nt, Homo sapiens
cuucaucuuaaccuuuuaguuccua

SEQ ID NO: 2400 - RNA, 25 nt, Homo sapiens
uaaacaaguaaaguuguuaguaucc

SEQ ID NO: 2401 - RNA, 25 nt, Homo sapiens
auccaggcacugaauuauaccuuca

SEQ ID NO: 2402 - RNA, 25 nt, Homo sapiens
acuucuuuaacaaguguaccgcuac

SEQ ID NO: 2403 - RNA, 25 nt, Homo sapiens
aaacgucucuagcaaugaucuuuau

SEQ ID NO: 2404 - RNA, 25 nt, Homo sapiens
aacgucucuagcaaugaucuuuauc

SEQ ID NO: 2405 - RNA, 25 nt, Homo sapiens
aaaacauuaagaugaaugugcgcuu

SEQ ID NO: 2406 - RNA, 25 nt, Homo sapiens
gcaacauccauagcuuacaguuauu

SEQ ID NO: 2407 - RNA, 25 nt, Homo sapiens
gcaacuaugaaaccacaguuacuaa

SEQ ID NO: 2408 - RNA, 25 nt, Homo sapiens
aaauguacuuauuuguauaugaaag

SEQ ID NO: 2409 - RNA, 25 nt, Homo sapiens
auugauauguaauuuuuacuugaaa

SEQ ID NO: 2410 - RNA, 25 nt, Homo sapiens
uguaauuuuuacuugaaauggccua

SEQ ID NO: 2411 - RNA, 25 nt, Homo sapiens
aauaguaauuaagcacaccuuuucu

SEQ ID NO: 2412 - RNA, 25 nt, Homo sapiens
uuucucauacaugcuaauacucauu

SEQ ID NO: 2413 - RNA, 25 nt, Homo sapiens
aauuuuuaaccaaauaacaguguag

SEQ ID NO: 2414 - RNA, 25 nt, Homo sapiens
augucuucccaugaucaaagaucaa

SEQ ID NO: 2415 - RNA, 25 nt, Homo sapiens
cuucccaugaucaaagaucaaagga

SEQ ID NO: 2416 - RNA, 25 nt, Homo sapiens
ccaugaucaaagaucaaaggaagga

SEQ ID NO: 2417 - RNA, 25 nt, Homo sapiens
ccauaccuauuugucuuauuaaucu

SEQ ID NO: 2418 - RNA, 25 nt, Homo sapiens
cauucauaaaaaucaucugacuagu

SEQ ID NO: 2419 - RNA, 25 nt, Homo sapiens
gacuaguaggaaauaauaguagacu

SEQ ID NO: 2420 - RNA, 25 nt, Homo sapiens
uguauauaaauuaaccuuuguuucu

SEQ ID NO: 2421 - RNA, 25 nt, Homo sapiens
cuucauauuucaugcuuuugacaua

SEQ ID NO: 2422 - RNA, 25 nt, Homo sapiens
uucaugcuuuugacauaaggugaaa

SEQ ID NO: 2423 - RNA, 25 nt, Homo sapiens
uaccaaccugaagagagaagcagua

SEQ ID NO: 2424 - RNA, 25 nt, Homo sapiens
gauaccugaagccuguguaacucag

SEQ ID NO: 2425 - RNA, 25 nt, Homo sapiens
ggaaacauacagcauguguuuacau

SEQ ID NO: 2426 - RNA, 25 nt, Homo sapiens
auguguuuacauuggucguacaugc

SEQ ID NO: 2427 - RNA, 25 nt, Homo sapiens
uguguuuacauuggucguacaugca

SEQ ID NO: 2428 - RNA, 25 nt, Homo sapiens
ucucugccugugaaagauaaauagc

SEQ ID NO: 2429 - RNA, 25 nt, Homo sapiens
cucugccugugaaagauaaauagca

SEQ ID NO: 2430 - RNA, 25 nt, Homo sapiens
uuguuuuuuuuuuuuuuuuuuucuu

SEQ ID NO: 2431 - RNA, 25 nt, Homo sapiens
uaccaugaagguauaauucagugcc

SEQ ID NO: 2432 - RNA, 25 nt, Homo sapiens
aucauagcuuugauugauaccauga

SEQ ID NO: 2433 - RNA, 25 nt, Homo sapiens
uagagacguuuaauguuaccuguag

SEQ ID NO: 2434 - RNA, 25 nt, Homo sapiens
agaaguauuaauaauauuucaguca

SEQ ID NO: 2435 - RNA, 25 nt, Homo sapiens
ucaacaaaaaguuauuuuauguuaa

SEQ ID NO: 2436 - RNA, 25 nt, Homo sapiens
auaguugccaaauaacuguaagcua

SEQ ID NO: 2437 - RNA, 25 nt, Homo sapiens
aaagucuuaauuccauuaguaacug

SEQ ID NO: 2438 - RNA, 25 nt, Homo sapiens
ugaacuaguugguauuauaaaccuu

SEQ ID NO: 2439 - RNA, 25 nt, Homo sapiens
aaauuuuaaagcucuaugaacuagu

SEQ ID NO: 2440 - RNA, 25 nt, Homo sapiens
ugucagagauucauuaucuagaaaa

SEQ ID NO: 2441 - RNA, 25 nt, Homo sapiens
ggauugguuaacauagcaugggagc

SEQ ID NO: 2442 - RNA, 25 nt, Homo sapiens
uauuggggauugguuaacauagcau

SEQ ID NO: 2443 - RNA, 25 nt, Homo sapiens
cuauuggggauugguuaacauagca

SEQ ID NO: 2444 - RNA, 25 nt, Homo sapiens
ggugugcuuaauuacuauuggggau

SEQ ID NO: 2445 - RNA, 25 nt, Homo sapiens
gaaaaggugugcuuaauuacuauug

SEQ ID NO: 2446 - RNA, 25 nt, Homo sapiens
agaaaaggugugcuuaauuacuauu

SEQ ID NO: 2447 - RNA, 25 nt, Homo sapiens
uagaaaaggugugcuuaauuacuau

SEQ ID NO: 2448 - RNA, 25 nt, Homo sapiens
gggagaaaaaggcgcauccuagaaa

SEQ ID NO: 2449 - RNA, 25 nt, Homo sapiens
auguaugagaaauuaugggagaaaa

SEQ ID NO: 2450 - RNA, 25 nt, Homo sapiens
aguauuagcauguaugagaaauuau

SEQ ID NO: 2451 - RNA, 25 nt, Homo sapiens
gaguauuagcauguaugagaaauua

SEQ ID NO: 2452 - RNA, 25 nt, Homo sapiens
ugauuuuguccacuacacuguuauu

SEQ ID NO: 2453 - RNA, 25 nt, Homo sapiens
uuugaucuuugaucaugggaagaca

SEQ ID NO: 2454 - RNA, 25 nt, Homo sapiens
cuuccuuccuuugaucuuugaucau

SEQ ID NO: 2455 - RNA, 25 nt, Homo sapiens
ccuuccuuccuuugaucuuugauca

SEQ ID NO: 2456 - RNA, 25 nt, Homo sapiens
aacagagagguauaugagcugcaua

SEQ ID NO: 2457 - RNA, 25 nt, Homo sapiens
aaacagagagguauaugagcugcau

SEQ ID NO: 2458 - RNA, 25 nt, Homo sapiens
acaaauagguauggcagaaacagag

SEQ ID NO: 2459 - RNA, 25 nt, Homo sapiens
ccaagauuaauaagacaaauaggua

SEQ ID NO: 2460 - RNA, 25 nt, Homo sapiens
ugacaccaagauuaauaagacaaau

SEQ ID NO: 2461 - RNA, 25 nt, Homo sapiens
uuuuuaugaauguaaaauauuagaa

SEQ ID NO: 2462 - RNA, 25 nt, Homo sapiens
augaaauaugaaggccuagaaacaa

SEQ ID NO: 2463 - RNA, 25 nt, Homo sapiens
cuuaugucaaaagcaugaaauauga

SEQ ID NO: 2464 - RNA, 25 nt, Homo sapiens
aaccuuacugcuucucucuucaggu

SEQ ID NO: 2465 - RNA, 25 nt, Homo sapiens
ugaaaaccuuacugcuucucucuuc

SEQ ID NO: 2466 - RNA, 25 nt, Homo sapiens
guuuccucugaguuacacaggcuuc

SEQ ID NO: 2467 - RNA, 25 nt, Homo sapiens
gcuguauguuuccucugaguuacac

SEQ ID NO: 2468 - RNA, 25 nt, Homo sapiens
caacuuacucauuaauaaucagauc

SEQ ID NO: 2469 - RNA, 25 nt, Homo sapiens
aaucagaucaggagcaaaacacagc

SEQ ID NO: 2470 - RNA, 25 nt, Homo sapiens
agagcaaaugccauaagaaacaucc

SEQ ID NO: 2471 - RNA, 25 nt, Homo sapiens
aagaaacauccaggaguacugcagu

SEQ ID NO: 2472 - RNA, 25 nt, Homo sapiens
agaaacauccaggaguacugcagua

SEQ ID NO: 2473 - RNA, 25 nt, Homo sapiens
ccaggaguacugcaguagggucauu

SEQ ID NO: 2474 - RNA, 25 nt, Homo sapiens
cugcaguagggucauuuggucaucc

SEQ ID NO: 2475 - RNA, 25 nt, Homo sapiens
cugaaaccugaauuaagagaaauaa

SEQ ID NO: 2476 - RNA, 25 nt, Homo sapiens
guuucuuauggcauuugcucugggg

SEQ ID NO: 2477 - RNA, 25 nt, Homo sapiens
gauguuucuuauggcauuugcucug

SEQ ID NO: 2478 - RNA, 25 nt, Homo sapiens
ggauguuucuuauggcauuugcucu

SEQ ID NO: 2479 - RNA, 25 nt, Homo sapiens
uggauguuucuuauggcauuugcuc

SEQ ID NO: 2480 - RNA, 25 nt, Homo sapiens
cugcaguacuccuggauguuucuua

SEQ ID NO: 2481 - RNA, 25 nt, Homo sapiens
ccaaaugacccuacugcaguacucc

SEQ ID NO: 2482 - RNA, 25 nt, Homo sapiens
aauucagguuucaggaacuuacacc

SEQ ID NO: 2483 - RNA, 25 nt, Homo sapiens
cuuuauuucucuuaauucagguuuc

SEQ ID NO: 2484 - RNA, 25 nt, Homo sapiens
gcucuuuuauguuuugcaucuuacc

SEQ ID NO: 2485 - RNA, 25 nt, Homo sapiens
uagucaugauccuccaaguugaguc

SEQ ID NO: 2486 - RNA, 25 nt, Homo sapiens
uaucauauccugcauauaacacuuc

SEQ ID NO: 2487 - RNA, 25 nt, Homo sapiens
uucaauaaccuccaacagugacacc

SEQ ID NO: 2488 - RNA, 25 nt, Homo sapiens
ucaauaaccuccaacagugacacca

SEQ ID NO: 2489 - RNA, 25 nt, Homo sapiens
uaaccuccaacagugacaccagggu

SEQ ID NO: 2490 - RNA, 25 nt, Homo sapiens
aaccuccaacagugacaccagggua

SEQ ID NO: 2491 - RNA, 25 nt, Homo sapiens
accuccaacagugacaccaggguag

SEQ ID NO: 2492 - RNA, 25 nt, Homo sapiens
gugacaccaggguaggggugaguug

SEQ ID NO: 2493 - RNA, 25 nt, Homo sapiens
uaggggugaguugugguaacguugc

SEQ ID NO: 2494 - RNA, 25 nt, Homo sapiens
uugcaggaacuauuguuuuguuacc

SEQ ID NO: 2495 - RNA, 25 nt, Homo sapiens
auuguuuuguuaccaggauuuucag

SEQ ID NO: 2496 - RNA, 25 nt, Homo sapiens
gagguuucuugugagacuccuguag

SEQ ID NO: 2497 - RNA, 25 nt, Homo sapiens
auuuuuuucuuuguuuuucgagcug

SEQ ID NO: 2498 - RNA, 25 nt, Homo sapiens
uuuuuuucuuuguuuuucgagcugu

SEQ ID NO: 2499 - RNA, 25 nt, Homo sapiens
cagugaaaugggcaaaggcaauacc

SEQ ID NO: 2500 - RNA, 25 nt, Homo sapiens
gugauugcagcagugaaaugggcaa

SEQ ID NO: 2501 - RNA, 25 nt, Homo sapiens
cggcaagugauugcagcagugaaau

SEQ ID NO: 2502 - RNA, 25 nt, Homo sapiens
gcggcaagugauugcagcagugaaa

SEQ ID NO: 2503 - RNA, 25 nt, Homo sapiens
gacuacgcucaacauguuaggaggg

SEQ ID NO: 2504 - RNA, 25 nt, Homo sapiens
caugacuacgcucaacauguuagga

SEQ ID NO: 2505 - RNA, 25 nt, Homo sapiens
ucaugacuacgcucaacauguuagg

SEQ ID NO: 2506 - RNA, 25 nt, Homo sapiens
ggaucaugacuacgcucaacauguu

SEQ ID NO: 2507 - RNA, 25 nt, Homo sapiens
uagcucuguuccagacucaacuugg

SEQ ID NO: 2508 - RNA, 25 nt, Homo sapiens
ugauagcucuguuccagacucaacu

SEQ ID NO: 2509 - RNA, 25 nt, Homo sapiens
uuauugaaccugaaguguuauaugc

SEQ ID NO: 2510 - RNA, 25 nt, Homo sapiens
accccuacccuggugucacuguugg

SEQ ID NO: 2511 - RNA, 25 nt, Homo sapiens
cucaccccuacccuggugucacugu

SEQ ID NO: 2512 - RNA, 25 nt, Homo sapiens
acguuaccacaacucaccccuaccc

SEQ ID NO: 2513 - RNA, 25 nt, Homo sapiens
ucucacaagaaaccucugaaaaucc

SEQ ID NO: 2514 - RNA, 25 nt, Homo sapiens
uaaaaggaauucagcaggccacuac

SEQ ID NO: 2515 - RNA, 25 nt, Homo sapiens
aagaaaaaaauaaaaggaauucagc

SEQ ID NO: 2516 - RNA, 25 nt, Homo sapiens
cucgaaaaacaaagaaaaaaauaaa

SEQ ID NO: 2517 - RNA, 25 nt, Homo sapiens
cuuucagauauuuauauuaccuucc

SEQ ID NO: 2518 - RNA, 25 nt, Homo sapiens
uccagccugaagacauuuucgauag

SEQ ID NO: 2519 - RNA, 25 nt, Homo sapiens
gaagacauuuucgauagcggcaugc

SEQ ID NO: 2520 - RNA, 25 nt, Homo sapiens
aagacauuuucgauagcggcaugcu

SEQ ID NO: 2521 - RNA, 25 nt, Homo sapiens
gaugcaaucauuccuuccagcacau

SEQ ID NO: 2522 - RNA, 25 nt, Homo sapiens
acauagguaauugugcuguccuaua

SEQ ID NO: 2523 - RNA, 25 nt, Homo sapiens
auugugcuguccuauauggaauaaa

SEQ ID NO: 2524 - RNA, 25 nt, Homo sapiens
gucuucaggcuggaaugaaccugga

SEQ ID NO: 2525 - RNA, 25 nt, Homo sapiens
aaaugucuucaggcuggaaugaacc

SEQ ID NO: 2526 - RNA, 25 nt, Homo sapiens
gccgcuaucgaaaaugucuucaggc

SEQ ID NO: 2527 - RNA, 25 nt, Homo sapiens
gcaugccgcuaucgaaaaugucuuc

SEQ ID NO: 2528 - RNA, 25 nt, Homo sapiens
acagcacaauuaccuaugugcugga

SEQ ID NO: 2529 - RNA, 25 nt, Homo sapiens
uaggacagcacaauuaccuaugugc

SEQ ID NO: 2530 - RNA, 25 nt, Homo sapiens
uccugaagcuucaucagagcacacc

SEQ ID NO: 2531 - RNA, 25 nt, Homo sapiens
ucaucagagcacaccaggcagaguu

SEQ ID NO: 2532 - RNA, 25 nt, Homo sapiens
caucagagcacaccaggcagaguuu

SEQ ID NO: 2533 - RNA, 25 nt, Homo sapiens
cagagcacaccaggcagaguuuggg

SEQ ID NO: 2534 - RNA, 25 nt, Homo sapiens
agcacaccaggcagaguuugggagg

SEQ ID NO: 2535 - RNA, 25 nt, Homo sapiens
ggaggugguccuguuguugcuguug

SEQ ID NO: 2536 - RNA, 25 nt, Homo sapiens
gguccuguuguugcuguugaggagc

SEQ ID NO: 2537 - RNA, 25 nt, Homo sapiens
cuguuguugcuguugaggagcugga

SEQ ID NO: 2538 - RNA, 25 nt, Homo sapiens
uuguugcuguugaggagcuggaugg

SEQ ID NO: 2539 - RNA, 25 nt, Homo sapiens
agcuggauggaggagagcuuacauc

SEQ ID NO: 2540 - RNA, 25 nt, Homo sapiens
ggagagcuuacaucuggucucaugc

SEQ ID NO: 2541 - RNA, 25 nt, Homo sapiens
gagagcuuacaucuggucucaugcu

SEQ ID NO: 2542 - RNA, 25 nt, Homo sapiens
agagcuuacaucuggucucaugcug

SEQ ID NO: 2543 - RNA, 25 nt, Homo sapiens
ucuggucucaugcuggggcuaaaga

SEQ ID NO: 2544 - RNA, 25 nt, Homo sapiens
cuggucucaugcuggggcuaaagaa

SEQ ID NO: 2545 - RNA, 25 nt, Homo sapiens
uggucucaugcuggggcuaaagaag

SEQ ID NO: 2546 - RNA, 25 nt, Homo sapiens
aaguuuucuucaaaagagcagugga

SEQ ID NO: 2547 - RNA, 25 nt, Homo sapiens
uguaaaguuuucuucaaaagagcag

SEQ ID NO: 2548 - RNA, 25 nt, Homo sapiens
gaugucauuauggagucuuaacuug

SEQ ID NO: 2549 - RNA, 25 nt, Homo sapiens
cugaugaagcuucaggaugucauua

SEQ ID NO: 2550 - RNA, 25 nt, Homo sapiens
gccuggugugcucugaugaagcuuc

SEQ ID NO: 2551 - RNA, 25 nt, Homo sapiens
acaggaccaccucccaaacucugcc

SEQ ID NO: 2552 - RNA, 25 nt, Homo sapiens
cauccagcuccucaacagcaacaac

SEQ ID NO: 2553 - RNA, 25 nt, Homo sapiens
agccauuagaaaaaacuguucgacc

SEQ ID NO: 2554 - RNA, 25 nt, Homo sapiens
gccauuagaaaaaacuguucgacca

SEQ ID NO: 2555 - RNA, 25 nt, Homo sapiens
agucaaguugucaucuccagauccu

SEQ ID NO: 2556 - RNA, 25 nt, Homo sapiens
gauccuuggcaccuauuccaauuuu

SEQ ID NO: 2557 - RNA, 25 nt, Homo sapiens
caccuauuccaauuuucggaaccaa

SEQ ID NO: 2558 - RNA, 25 nt, Homo sapiens
accuauuccaauuuucggaaccaac

SEQ ID NO: 2559 - RNA, 25 nt, Homo sapiens
uccaauuuucggaaccaacgggaau

SEQ ID NO: 2560 - RNA, 25 nt, Homo sapiens
aauuuucggaaccaacgggaauugg

SEQ ID NO: 2561 - RNA, 25 nt, Homo sapiens
gaauugguggaaugacauuaaaaau

SEQ ID NO: 2562 - RNA, 25 nt, Homo sapiens
aggcuucugauccugcuguugagaa

SEQ ID NO: 2563 - RNA, 25 nt, Homo sapiens
ggcuucugauccugcuguugagaaa

SEQ ID NO: 2564 - RNA, 25 nt, Homo sapiens
aagggaugcuguauucaugucauag

SEQ ID NO: 2565 - RNA, 25 nt, Homo sapiens
ucauagugguacaucuguccuccag

SEQ ID NO: 2566 - RNA, 25 nt, Homo sapiens
gagguacucacaccaugaacagaaa

SEQ ID NO: 2567 - RNA, 25 nt, Homo sapiens
uuuuauuaccaauuauauuugcucc

SEQ ID NO: 2568 - RNA, 25 nt, Homo sapiens
ccaguuucucuugcuuaauuacccc

SEQ ID NO: 2569 - RNA, 25 nt, Homo sapiens
caguuucucuugcuuaauuacccca

SEQ ID NO: 2570 - RNA, 25 nt, Homo sapiens
aguuucucuugcuuaauuaccccag

SEQ ID NO: 2571 - RNA, 25 nt, Homo sapiens
gaaaucuucuuuuucuguuuucacu

SEQ ID NO: 2572 - RNA, 25 nt, Homo sapiens
aaaucuucuuuuucuguuuucacuu

SEQ ID NO: 2573 - RNA, 25 nt, Homo sapiens
aaucuucuuuuucuguuuucacuug

SEQ ID NO: 2574 - RNA, 25 nt, Homo sapiens
uucacuuggggcaguguuacauuac

SEQ ID NO: 2575 - RNA, 25 nt, Homo sapiens
ucacuuggggcaguguuacauuacu

SEQ ID NO: 2576 - RNA, 25 nt, Homo sapiens
cacuuggggcaguguuacauuacug

SEQ ID NO: 2577 - RNA, 25 nt, Homo sapiens
accagaucuccauuauccuuaauuu

SEQ ID NO: 2578 - RNA, 25 nt, Homo sapiens
ccagaucuccauuauccuuaauuuu

SEQ ID NO: 2579 - RNA, 25 nt, Homo sapiens
uauccuuaauuuuggguuuaguguc

SEQ ID NO: 2580 - RNA, 25 nt, Homo sapiens
uggguuuaguguccgguaaaaugag

SEQ ID NO: 2581 - RNA, 25 nt, Homo sapiens
guccucauucgaguuuccuuccaaa

SEQ ID NO: 2582 - RNA, 25 nt, Homo sapiens
ggaaugaaucgucuucucccgccag

SEQ ID NO: 2583 - RNA, 25 nt, Homo sapiens
aagcaaacaguuuucaucuaucaac

SEQ ID NO: 2584 - RNA, 25 nt, Homo sapiens
caucuaucaacaggucugaucucca

SEQ ID NO: 2585 - RNA, 25 nt, Homo sapiens
aaggacucucauucgucucuuuacc

SEQ ID NO: 2586 - RNA, 25 nt, Homo sapiens
aggacucucauucgucucuuuaccu

SEQ ID NO: 2587 - RNA, 25 nt, Homo sapiens
ggacucucauucgucucuuuaccug

SEQ ID NO: 2588 - RNA, 25 nt, Homo sapiens
aacuccaaauccugcaaaaugucaa

SEQ ID NO: 2589 - RNA, 25 nt, Homo sapiens
auccugcaaaaugucaaaggugcuu

SEQ ID NO: 2590 - RNA, 25 nt, Homo sapiens
aaaaugucaaaggugcuuuggucug

SEQ ID NO: 2591 - RNA, 25 nt, Homo sapiens
guauacaauuucacauugccaccgu

SEQ ID NO: 2592 - RNA, 25 nt, Homo sapiens
cacauugccaccguuggugccaguc

SEQ ID NO: 2593 - RNA, 25 nt, Homo sapiens
cugaagauacaucagagugaguuuu

SEQ ID NO: 2594 - RNA, 25 nt, Homo sapiens
ugaguuuuuggaaacuccuucucug

SEQ ID NO: 2595 - RNA, 25 nt, Homo sapiens
gaguuuuuggaaacuccuucucugu

SEQ ID NO: 2596 - RNA, 25 nt, Homo sapiens
aguuuuuggaaacuccuucucugug

SEQ ID NO: 2597 - RNA, 25 nt, Homo sapiens
guuuuuggaaacuccuucucugugg

SEQ ID NO: 2598 - RNA, 25 nt, Homo sapiens
ucugugggggcagcagacacagcag

SEQ ID NO: 2599 - RNA, 25 nt, Homo sapiens
gacacagcaguggaugcugaacucu

SEQ ID NO: 2600 - RNA, 25 nt, Homo sapiens
acacagcaguggaugcugaacucuu

SEQ ID NO: 2601 - RNA, 25 nt, Homo sapiens
cacagcaguggaugcugaacucuug

SEQ ID NO: 2602 - RNA, 25 nt, Homo sapiens
uggaugcugaacucuugggguucuc

SEQ ID NO: 2603 - RNA, 25 nt, Homo sapiens
gaacucuugggguucucuggaacac

SEQ ID NO: 2604 - RNA, 25 nt, Homo sapiens
cucuggaacacuggucgaccuauug

SEQ ID NO: 2605 - RNA, 25 nt, Homo sapiens
aaaagcuuuaagucuguuucccccg

SEQ ID NO: 2606 - RNA, 25 nt, Homo sapiens
cuuuaagucuguuucccccgaggaa

SEQ ID NO: 2607 - RNA, 25 nt, Homo sapiens
uguuucccccgaggaaaggcugauu

SEQ ID NO: 2608 - RNA, 25 nt, Homo sapiens
aggaaaggcugauuuggcccugcug

SEQ ID NO: 2609 - RNA, 25 nt, Homo sapiens
ggaaaggcugauuuggcccugcugu

SEQ ID NO: 2610 - RNA, 25 nt, Homo sapiens
gauuuggcccugcugugggaauccc

SEQ ID NO: 2611 - RNA, 25 nt, Homo sapiens
agucccauugagagugaaacugcuu

SEQ ID NO: 2612 - RNA, 25 nt, Homo sapiens
agagugaaacugcuuuggacagauc

SEQ ID NO: 2613 - RNA, 25 nt, Homo sapiens
gcugcgcauugcuuacugagccuuu

SEQ ID NO: 2614 - RNA, 25 nt, Homo sapiens
aaaucaaccaaaagucuucgcugcu

SEQ ID NO: 2615 - RNA, 25 nt, Homo sapiens
ucugauugagaagcgacagccagug

SEQ ID NO: 2616 - RNA, 25 nt, Homo sapiens
cugauugagaagcgacagccaguga

SEQ ID NO: 2617 - RNA, 25 nt, Homo sapiens
aaccuucacaguagcuccuccucuu

SEQ ID NO: 2618 - RNA, 25 nt, Homo sapiens
accuucacaguagcuccuccucuua

SEQ ID NO: 2619 - RNA, 25 nt, Homo sapiens
ccccucuccugagcaagcacacugc

SEQ ID NO: 2620 - RNA, 25 nt, Homo sapiens
cccucuccugagcaagcacacugcu

SEQ ID NO: 2621 - RNA, 25 nt, Homo sapiens
ccucuccugagcaagcacacugcug

SEQ ID NO: 2622 - RNA, 25 nt, Homo sapiens
cacugcugggguuuucuucucuacc

SEQ ID NO: 2623 - RNA, 25 nt, Homo sapiens
ucucuaccaggaguuaaugauucuu

SEQ ID NO: 2624 - RNA, 25 nt, Homo sapiens
ucaacuacaaaacaaaaaacaaaaa

SEQ ID NO: 2625 - RNA, 25 nt, Homo sapiens
caacuacaaaacaaaaaacaaaaac

SEQ ID NO: 2626 - RNA, 25 nt, Homo sapiens
aacaguuuuuucuaauggcuauuca

SEQ ID NO: 2627 - RNA, 25 nt, Homo sapiens
ucccuggucgaacaguuuuuucuaa

SEQ ID NO: 2628 - RNA, 25 nt, Homo sapiens
cuucucuggggacucugaacuuccc

SEQ ID NO: 2629 - RNA, 25 nt, Homo sapiens
uggagaugacaacuugacuucucug

SEQ ID NO: 2630 - RNA, 25 nt, Homo sapiens
cuggagaugacaacuugacuucucu

SEQ ID NO: 2631 - RNA, 25 nt, Homo sapiens
ucuggagaugacaacuugacuucuc

SEQ ID NO: 2632 - RNA, 25 nt, Homo sapiens
aaaauuggaauaggugccaaggauc

SEQ ID NO: 2633 - RNA, 25 nt, Homo sapiens
guuccgaaaauuggaauaggugcca

SEQ ID NO: 2634 - RNA, 25 nt, Homo sapiens
ucccguugguuccgaaaauuggaau

SEQ ID NO: 2635 - RNA, 25 nt, Homo sapiens
accaauucccguugguuccgaaaau

SEQ ID NO: 2636 - RNA, 25 nt, Homo sapiens
uuaaugucauuccaccaauucccgu

SEQ ID NO: 2637 - RNA, 25 nt, Homo sapiens
aauacagcaucccuuucucaacagc

SEQ ID NO: 2638 - RNA, 25 nt, Homo sapiens
cuguucauggugugaguaccucugg

SEQ ID NO: 2639 - RNA, 25 nt, Homo sapiens
uuucuguucauggugugaguaccuc

SEQ ID NO: 2640 - RNA, 25 nt, Homo sapiens
auaaaaugucugccauuucuguuca

SEQ ID NO: 2641 - RNA, 25 nt, Homo sapiens
caagcuuuccuggagcaaauauaau

SEQ ID NO: 2642 - RNA, 25 nt, Homo sapiens
caguuuacugucaggcaagcuuucc

SEQ ID NO: 2643 - RNA, 25 nt, Homo sapiens
gagaaacugggcacaguuuacuguc

SEQ ID NO: 2644 - RNA, 25 nt, Homo sapiens
cugggguaauuaagcaagagaaacu

SEQ ID NO: 2645 - RNA, 25 nt, Homo sapiens
ccugggguaauuaagcaagagaaac

SEQ ID NO: 2646 - RNA, 25 nt, Homo sapiens
gauuucaucgaacucugcaccccug

SEQ ID NO: 2647 - RNA, 25 nt, Homo sapiens
agauuucaucgaacucugcaccccu

SEQ ID NO: 2648 - RNA, 25 nt, Homo sapiens
aagauuucaucgaacucugcacccc

SEQ ID NO: 2649 - RNA, 25 nt, Homo sapiens
cccaaaauuaaggauaauggagauc

SEQ ID NO: 2650 - RNA, 25 nt, Homo sapiens
acacuaaacccaaaauuaaggauaa

SEQ ID NO: 2651 - RNA, 25 nt, Homo sapiens
uuaccggacacuaaacccaaaauua

SEQ ID NO: 2652 - RNA, 25 nt, Homo sapiens
gaggacugcaagccucucauuuuac

SEQ ID NO: 2653 - RNA, 25 nt, Homo sapiens
uuccuuuuggaaggaaacucgaaug

SEQ ID NO: 2654 - RNA, 25 nt, Homo sapiens
gagaagacgauucauuccuuuugga

SEQ ID NO: 2655 - RNA, 25 nt, Homo sapiens
gcgggagaagacgauucauuccuuu

SEQ ID NO: 2656 - RNA, 25 nt, Homo sapiens
aaaacuguuugcuuucuccucuggc

SEQ ID NO: 2657 - RNA, 25 nt, Homo sapiens
gaaaacuguuugcuuucuccucugg

SEQ ID NO: 2658 - RNA, 25 nt, Homo sapiens
gaugaaaacuguuugcuuucuccuc

SEQ ID NO: 2659 - RNA, 25 nt, Homo sapiens
agguaaagagacgaaugagaguccu

SEQ ID NO: 2660 - RNA, 25 nt, Homo sapiens
auuuggaguuuucuucugggucccc

SEQ ID NO: 2661 - RNA, 25 nt, Homo sapiens
uuugcaggauuuggaguuuucuucu

SEQ ID NO: 2662 - RNA, 25 nt, Homo sapiens
uuuugcaggauuuggaguuuucuuc

SEQ ID NO: 2663 - RNA, 25 nt, Homo sapiens
agcaccuuugacauuuugcaggauu

SEQ ID NO: 2664 - RNA, 25 nt, Homo sapiens
gaccaaagcaccuuugacauuuugc

SEQ ID NO: 2665 - RNA, 25 nt, Homo sapiens
ugaagggccagacuggcaccaacgg

SEQ ID NO: 2666 - RNA, 25 nt, Homo sapiens
auuugaagggccagacuggcaccaa

SEQ ID NO: 2667 - RNA, 25 nt, Homo sapiens
aacagcaacauuugaagggccagac

SEQ ID NO: 2668 - RNA, 25 nt, Homo sapiens
uaucuucagaacagcaacauuugaa

SEQ ID NO: 2669 - RNA, 25 nt, Homo sapiens
guaucuucagaacagcaacauuuga

SEQ ID NO: 2670 - RNA, 25 nt, Homo sapiens
gcugugucugcugcccccacagaga

SEQ ID NO: 2671 - RNA, 25 nt, Homo sapiens
ggaagaaagcauugcaaaccucaau

SEQ ID NO: 2672 - RNA, 25 nt, Homo sapiens
ucgggggaaacagacuuaaagcuuu

SEQ ID NO: 2673 - RNA, 25 nt, Homo sapiens
cagggccaaaucagccuuuccucgg

SEQ ID NO: 2674 - RNA, 25 nt, Homo sapiens
gcagggccaaaucagccuuuccucg

SEQ ID NO: 2675 - RNA, 25 nt, Homo sapiens
agcagggccaaaucagccuuuccuc

SEQ ID NO: 2676 - RNA, 25 nt, Homo sapiens
cagcagggccaaaucagccuuuccu

SEQ ID NO: 2677 - RNA, 25 nt, Homo sapiens
gaaaugaccugggauucccacagca

SEQ ID NO: 2678 - RNA, 25 nt, Homo sapiens
ggaaaugaccugggauucccacagc

SEQ ID NO: 2679 - RNA, 25 nt, Homo sapiens
aaacaaaagugaugggaaaugaccu

SEQ ID NO: 2680 - RNA, 25 nt, Homo sapiens
gaaacaaaagugaugggaaaugacc

SEQ ID NO: 2681 - RNA, 25 nt, Homo sapiens
ugggagagacagaaacaaaagugau

SEQ ID NO: 2682 - RNA, 25 nt, Homo sapiens
augggagagacagaaacaaaaguga

SEQ ID NO: 2683 - RNA, 25 nt, Homo sapiens
uuucacucucaaugggacuguauau

SEQ ID NO: 2684 - RNA, 25 nt, Homo sapiens
guuucacucucaaugggacuguaua

SEQ ID NO: 2685 - RNA, 25 nt, Homo sapiens
uguccaaagcaguuucacucucaau

SEQ ID NO: 2686 - RNA, 25 nt, Homo sapiens
cuguccaaagcaguuucacucucaa

SEQ ID NO: 2687 - RNA, 25 nt, Homo sapiens
gaagacuuuugguugauuuuccaaa

SEQ ID NO: 2688 - RNA, 25 nt, Homo sapiens
ucagacuccaagcagcgaagacuuu

SEQ ID NO: 2689 - RNA, 25 nt, Homo sapiens
aagguuucugcgucuucacccucac

SEQ ID NO: 2690 - RNA, 25 nt, Homo sapiens
acccuaagaggaggagcuacuguga

SEQ ID NO: 2691 - RNA, 25 nt, Homo sapiens
uggacuucuauaaaacccuaagagg

SEQ ID NO: 2692 - RNA, 25 nt, Homo sapiens
ugauggacuucuauaaaacccuaag

SEQ ID NO: 2693 - RNA, 25 nt, Homo sapiens
cuugcucaggagaggggagauguga

SEQ ID NO: 2694 - RNA, 25 nt, Homo sapiens
ccagcagugugcuugcucaggagag

SEQ ID NO: 2695 - RNA, 25 nt, Homo sapiens
cccagcagugugcuugcucaggaga

SEQ ID NO: 2696 - RNA, 25 nt, Homo sapiens
ccccagcagugugcuugcucaggag

SEQ ID NO: 2697 - RNA, 25 nt, Homo sapiens
gaaaaccccagcagugugcuugcuc

SEQ ID NO: 2698 - RNA, 25 nt, Homo sapiens
uggacuccaaagaaucauuaacucc

SEQ ID NO: 2699 - RNA, 25 nt, Homo sapiens
uuguuuuguaguugauauucacuga

SEQ ID NO: 2700 - RNA, 25 nt, Homo sapiens
ccccucccgccucgcuucuuaccuc

SEQ ID NO: 2701 - RNA, 25 nt, Homo sapiens
ccgccucgcuucuuaccucuggcag

SEQ ID NO: 2702 - RNA, 25 nt, Homo sapiens
aaacaacuuagcuugugaacgcaga

SEQ ID NO: 2703 - RNA, 25 nt, Homo sapiens
cuuagcuugugaacgcagaaggagc

SEQ ID NO: 2704 - RNA, 25 nt, Homo sapiens
agcuugugaacgcagaaggagcagg

SEQ ID NO: 2705 - RNA, 25 nt, Homo sapiens
gcuugugaacgcagaaggagcagga

SEQ ID NO: 2706 - RNA, 25 nt, Homo sapiens
aaauauauuuuuuuuuucuaaaaaa

SEQ ID NO: 2707 - RNA, 25 nt, Homo sapiens
aaguaaacagccgccccuuucucca

SEQ ID NO: 2708 - RNA, 25 nt, Homo sapiens
aguaaacagccgccccuuucuccau

SEQ ID NO: 2709 - RNA, 25 nt, Homo sapiens
aaacagccgccccuuucuccauggg

SEQ ID NO: 2710 - RNA, 25 nt, Homo sapiens
aacagccgccccuuucuccaugggu

SEQ ID NO: 2711 - RNA, 25 nt, Homo sapiens
acagccgccccuuucuccaugggug

SEQ ID NO: 2712 - RNA, 25 nt, Homo sapiens
cagccgccccuuucuccaugggugg

SEQ ID NO: 2713 - RNA, 25 nt, Homo sapiens
agccgccccuuucuccauggguggg

SEQ ID NO: 2714 - RNA, 25 nt, Homo sapiens
gacaagccagcccuccgccccgcgc

SEQ ID NO: 2715 - RNA, 25 nt, Homo sapiens
acaagccagcccuccgccccgcgcc

SEQ ID NO: 2716 - RNA, 25 nt, Homo sapiens
gcccuccgccccgcgccgggcuccg

SEQ ID NO: 2717 - RNA, 25 nt, Homo sapiens
cccuccgccccgcgccgggcuccgc

SEQ ID NO: 2718 - RNA, 25 nt, Homo sapiens
gccccgcgccgggcuccgcgggucg

SEQ ID NO: 2719 - RNA, 25 nt, Homo sapiens
cgccgggcuccgcgggucgagguuc

SEQ ID NO: 2720 - RNA, 25 nt, Homo sapiens
gccgggcuccgcgggucgagguucc

SEQ ID NO: 2721 - RNA, 25 nt, Homo sapiens
gguuccgggcgcgcgugccccgucc

SEQ ID NO: 2722 - RNA, 25 nt, Homo sapiens
ugccccgucccggucccagcugcuu

SEQ ID NO: 2723 - RNA, 25 nt, Homo sapiens
ccggucccagcugcuucggccgcuc

SEQ ID NO: 2724 - RNA, 25 nt, Homo sapiens
ccagcugcuucggccgcuccggcug

SEQ ID NO: 2725 - RNA, 25 nt, Homo sapiens
uuccacccacagaauccguccccga

SEQ ID NO: 2726 - RNA, 25 nt, Homo sapiens
uccacccacagaauccguccccgac

SEQ ID NO: 2727 - RNA, 25 nt, Homo sapiens
cccacagaauccguccccgacgggc

SEQ ID NO: 2728 - RNA, 25 nt, Homo sapiens
acagaauccguccccgacgggcagg

SEQ ID NO: 2729 - RNA, 25 nt, Homo sapiens
cguccccgacgggcaggcggugacu

SEQ ID NO: 2730 - RNA, 25 nt, Homo sapiens
guccccgacgggcaggcggugacuc

SEQ ID NO: 2731 - RNA, 25 nt, Homo sapiens
ccgucacagacacgagcucgcaaaa

SEQ ID NO: 2732 - RNA, 25 nt, Homo sapiens
ucacagacacgagcucgcaaaaugg

SEQ ID NO: 2733 - RNA, 25 nt, Homo sapiens
cagacacgagcucgcaaaauggagg

SEQ ID NO: 2734 - RNA, 25 nt, Homo sapiens
acacgagcucgcaaaauggaggagg

SEQ ID NO: 2735 - RNA, 25 nt, Homo sapiens
cgagcucgcaaaauggaggaggcgg

SEQ ID NO: 2736 - RNA, 25 nt, Homo sapiens
gcucgcaaaauggaggaggcggcgg

SEQ ID NO: 2737 - RNA, 25 nt, Homo sapiens
cgcaaaauggaggaggcggcggcgg

SEQ ID NO: 2738 - RNA, 25 nt, Homo sapiens
gcaaaauggaggaggcggcggcgga

SEQ ID NO: 2739 - RNA, 25 nt, Homo sapiens
aggcggcggcggagggaagagagcg

SEQ ID NO: 2740 - RNA, 25 nt, Homo sapiens
agggaagagagcgcggacacgcgaa

SEQ ID NO: 2741 - RNA, 25 nt, Homo sapiens
gggaagagagcgcggacacgcgaaa

SEQ ID NO: 2742 - RNA, 25 nt, Homo sapiens
agcgcggacacgcgaaagggcagcc

SEQ ID NO: 2743 - RNA, 25 nt, Homo sapiens
ggacacgcgaaagggcagcccggcc

SEQ ID NO: 2744 - RNA, 25 nt, Homo sapiens
gacacgcgaaagggcagcccggccu

SEQ ID NO: 2745 - RNA, 25 nt, Homo sapiens
gggcagcccggccugggcgagcgag

SEQ ID NO: 2746 - RNA, 25 nt, Homo sapiens
ggcagcccggccugggcgagcgagc

SEQ ID NO: 2747 - RNA, 25 nt, Homo sapiens
gccugggcgagcgagcgggaccgag

SEQ ID NO: 2748 - RNA, 25 nt, Homo sapiens
ccugggcgagcgagcgggaccgagc

SEQ ID NO: 2749 - RNA, 25 nt, Homo sapiens
cugggcgagcgagcgggaccgagcg

SEQ ID NO: 2750 - RNA, 25 nt, Homo sapiens
cgagcgagcgggaccgagcggggag

SEQ ID NO: 2751 - RNA, 25 nt, Homo sapiens
gagcgagcgggaccgagcggggagc

SEQ ID NO: 2752 - RNA, 25 nt, Homo sapiens
cgagcgggaccgagcggggagcggg

SEQ ID NO: 2753 - RNA, 25 nt, Homo sapiens
gcgggaccgagcggggagcgggugg

SEQ ID NO: 2754 - RNA, 25 nt, Homo sapiens
ggaccgagcggggagcggguggagg

SEQ ID NO: 2755 - RNA, 25 nt, Homo sapiens
cggggagcggguggaggcggcgcca

SEQ ID NO: 2756 - RNA, 25 nt, Homo sapiens
cagagguaagaagcgaggcgggagg

SEQ ID NO: 2757 - RNA, 25 nt, Homo sapiens
ccagagguaagaagcgaggcgggag

SEQ ID NO: 2758 - RNA, 25 nt, Homo sapiens
gccagagguaagaagcgaggcggga

SEQ ID NO: 2759 - RNA, 25 nt, Homo sapiens
ugccagagguaagaagcgaggcggg

SEQ ID NO: 2760 - RNA, 25 nt, Homo sapiens
cucugccagagguaagaagcgaggc

SEQ ID NO: 2761 - RNA, 25 nt, Homo sapiens
ccucugccagagguaagaagcgagg

SEQ ID NO: 2762 - RNA, 25 nt, Homo sapiens
gcuccucugccagagguaagaagcg

SEQ ID NO: 2763 - RNA, 25 nt, Homo sapiens
ggcgggcgagcggcuccucugccag

SEQ ID NO: 2764 - RNA, 25 nt, Homo sapiens
ggaacugcggacgguggcgggcgag

SEQ ID NO: 2765 - RNA, 25 nt, Homo sapiens
ugcggcgggaacugcggacgguggc

SEQ ID NO: 2766 - RNA, 25 nt, Homo sapiens
cugcggcgggaacugcggacggugg

SEQ ID NO: 2767 - RNA, 25 nt, Homo sapiens
cggcugcggcgggaacugcggacgg

SEQ ID NO: 2768 - RNA, 25 nt, Homo sapiens
ucucggcugcggcgggaacugcgga

SEQ ID NO: 2769 - RNA, 25 nt, Homo sapiens
uuuaucucggcugcggcgggaacug

SEQ ID NO: 2770 - RNA, 25 nt, Homo sapiens
cuaaguuguuuaucucggcugcggc

SEQ ID NO: 2771 - RNA, 25 nt, Homo sapiens
gcuaaguuguuuaucucggcugcgg

SEQ ID NO: 2772 - RNA, 25 nt, Homo sapiens
caagcuaaguuguuuaucucggcug

SEQ ID NO: 2773 - RNA, 25 nt, Homo sapiens
cguucacaagcuaaguuguuuaucu

SEQ ID NO: 2774 - RNA, 25 nt, Homo sapiens
cuccccccacccauggagaaagggg

SEQ ID NO: 2775 - RNA, 25 nt, Homo sapiens
gcucuccccccacccauggagaaag

SEQ ID NO: 2776 - RNA, 25 nt, Homo sapiens
ggcucuccccccacccauggagaaa

SEQ ID NO: 2777 - RNA, 25 nt, Homo sapiens
gggcucuccccccacccauggagaa

SEQ ID NO: 2778 - RNA, 25 nt, Homo sapiens
uaaauaggggcucuccccccaccca

SEQ ID NO: 2779 - RNA, 25 nt, Homo sapiens
ggcaaugggagacuuucuuaaauag

SEQ ID NO: 2780 - RNA, 25 nt, Homo sapiens
gggcaaugggagacuuucuuaaaua

SEQ ID NO: 2781 - RNA, 25 nt, Homo sapiens
ugggcaaugggagacuuucuuaaau

SEQ ID NO: 2782 - RNA, 25 nt, Homo sapiens
agggcuggcuugucagcugggcaau

SEQ ID NO: 2783 - RNA, 25 nt, Homo sapiens
gagggcuggcuugucagcugggcaa

SEQ ID NO: 2784 - RNA, 25 nt, Homo sapiens
ggggcggagggcuggcuugucagcu

SEQ ID NO: 2785 - RNA, 25 nt, Homo sapiens
cggggcggagggcuggcuugucagc

SEQ ID NO: 2786 - RNA, 25 nt, Homo sapiens
cggagcccggcgcggggcggagggc

SEQ ID NO: 2787 - RNA, 25 nt, Homo sapiens
cccgcggagcccggcgcggggcgga

SEQ ID NO: 2788 - RNA, 25 nt, Homo sapiens
acccgcggagcccggcgcggggcgg

SEQ ID NO: 2789 - RNA, 25 nt, Homo sapiens
ucgacccgcggagcccggcgcgggg

SEQ ID NO: 2790 - RNA, 25 nt, Homo sapiens
accucgacccgcggagcccggcgcg

SEQ ID NO: 2791 - RNA, 25 nt, Homo sapiens
aaccucgacccgcggagcccggcgc

SEQ ID NO: 2792 - RNA, 25 nt, Homo sapiens
gaaccucgacccgcggagcccggcg

SEQ ID NO: 2793 - RNA, 25 nt, Homo sapiens
gcccggaaccucgacccgcggagcc

SEQ ID NO: 2794 - RNA, 25 nt, Homo sapiens
cacgcgcgcccggaaccucgacccg

SEQ ID NO: 2795 - RNA, 25 nt, Homo sapiens
gggaccgggacggggcacgcgcgcc

SEQ ID NO: 2796 - RNA, 25 nt, Homo sapiens
ggccgaagcagcugggaccgggacg

SEQ ID NO: 2797 - RNA, 25 nt, Homo sapiens
cggccgaagcagcugggaccgggac

SEQ ID NO: 2798 - RNA, 25 nt, Homo sapiens
gcggccgaagcagcugggaccggga

SEQ ID NO: 2799 - RNA, 25 nt, Homo sapiens
cggagcggccgaagcagcugggacc

SEQ ID NO: 2800 - RNA, 25 nt, Homo sapiens
ccggagcggccgaagcagcugggac

SEQ ID NO: 2801 - RNA, 25 nt, Homo sapiens
cgcagccggagcggccgaagcagcu

SEQ ID NO: 2802 - RNA, 25 nt, Homo sapiens
ccgcagccggagcggccgaagcagc

SEQ ID NO: 2803 - RNA, 25 nt, Homo sapiens
guggaaggagacgccgcagccggag

SEQ ID NO: 2804 - RNA, 25 nt, Homo sapiens
uguggguggaaggagacgccgcagc

SEQ ID NO: 2805 - RNA, 25 nt, Homo sapiens
gucggggacggauucugugggugga

SEQ ID NO: 2806 - RNA, 25 nt, Homo sapiens
gcccgucggggacggauucuguggg

SEQ ID NO: 2807 - RNA, 25 nt, Homo sapiens
ccugcccgucggggacggauucugu

SEQ ID NO: 2808 - RNA, 25 nt, Homo sapiens
gccugcccgucggggacggauucug

SEQ ID NO: 2809 - RNA, 25 nt, Homo sapiens
cgagucaccgccugcccgucgggga

SEQ ID NO: 2810 - RNA, 25 nt, Homo sapiens
agcccgagucaccgccugcccgucg

SEQ ID NO: 2811 - RNA, 25 nt, Homo sapiens
gagcccgagucaccgccugcccguc

SEQ ID NO: 2812 - RNA, 25 nt, Homo sapiens
ggagcccgagucaccgccugcccgu

SEQ ID NO: 2813 - RNA, 25 nt, Homo sapiens
cauuuugcgagcucgugucugugac

SEQ ID NO: 2814 - RNA, 25 nt, Homo sapiens
ccauuuugcgagcucgugucuguga

SEQ ID NO: 2815 - RNA, 25 nt, Homo sapiens
ucggucccgcucgcucgcccaggcc

SEQ ID NO: 2816 - RNA, 25 nt, Homo sapiens
cucggucccgcucgcucgcccaggc

SEQ ID NO: 2817 - RNA, 25 nt, Homo sapiens
cccgcucggucccgcucgcucgccc

SEQ ID NO: 2818 - RNA, 25 nt, Homo sapiens
gcgccgccuccacccgcuccccgcu

SEQ ID NO: 2819 - RNA, 25 nt, Homo sapiens
agcgggggucggcgcauacguacuu

SEQ ID NO: 2820 - RNA, 25 nt, Homo sapiens
gcgggggucggcgcauacguacuuu

SEQ ID NO: 2821 - RNA, 25 nt, Homo sapiens
ggucggcgcauacguacuuugggcc

SEQ ID NO: 2822 - RNA, 25 nt, Homo sapiens
gucggcgcauacguacuuugggccc

SEQ ID NO: 2823 - RNA, 25 nt, Homo sapiens
ucggcgcauacguacuuugggcccg

SEQ ID NO: 2824 - RNA, 25 nt, Homo sapiens
cggcgcauacguacuuugggcccgg

SEQ ID NO: 2825 - RNA, 25 nt, Homo sapiens
ggcgcauacguacuuugggcccggg

SEQ ID NO: 2826 - RNA, 25 nt, Homo sapiens
uuugggcccggggggagucgcgugc

SEQ ID NO: 2827 - RNA, 25 nt, Homo sapiens
ggcccggggggagucgcgugccggc

SEQ ID NO: 2828 - RNA, 25 nt, Homo sapiens
gcaggucccccaccaccgcaucauc

SEQ ID NO: 2829 - RNA, 25 nt, Homo sapiens
caggucccccaccaccgcaucaucu

SEQ ID NO: 2830 - RNA, 25 nt, Homo sapiens
gucccccaccaccgcaucaucuggg

SEQ ID NO: 2831 - RNA, 25 nt, Homo sapiens
cccaccaccgcaucaucugggcggc

SEQ ID NO: 2832 - RNA, 25 nt, Homo sapiens
ccaccaccgcaucaucugggcggcc

SEQ ID NO: 2833 - RNA, 25 nt, Homo sapiens
agcugccgccgccgcgcucucgcac

SEQ ID NO: 2834 - RNA, 25 nt, Homo sapiens
gcugccgccgccgcgcucucgcacu

SEQ ID NO: 2835 - RNA, 25 nt, Homo sapiens
gaccugccggcacgcgacucccccc

SEQ ID NO: 2836 - RNA, 25 nt, Homo sapiens
ggaccugccggcacgcgacuccccc

SEQ ID NO: 2837 - RNA, 25 nt, Homo sapiens
gaugaugcgguggugggggaccugc

SEQ ID NO: 2838 - RNA, 25 nt, Homo sapiens
ggccgcccagaugaugcgguggugg

SEQ ID NO: 2839 - RNA, 25 nt, Homo sapiens
cggccgcccagaugaugcgguggug

SEQ ID NO: 2840 - RNA, 25 nt, Homo sapiens
ccggccgcccagaugaugcgguggu

SEQ ID NO: 2841 - RNA, 25 nt, Homo sapiens
cccggccgcccagaugaugcggugg

SEQ ID NO: 2842 - RNA, 25 nt, Homo sapiens
agacccggccgcccagaugaugcgg

SEQ ID NO: 2843 - RNA, 25 nt, Homo sapiens
ugaagacccggccgcccagaugaug

SEQ ID NO: 2844 - RNA, 25 nt, Homo sapiens
agcgcggcggcggcagcugaagacc

SEQ ID NO: 2845 - RNA, 25 nt, Homo sapiens
cucucccagugcgagagcgcggcgg

SEQ ID NO: 2846 - RNA, 25 nt, Homo sapiens
cuucucucccagugcgagagcgcgg

SEQ ID NO: 2847 - RNA, 25 nt, Homo sapiens
caacuucucucccagugcgagagcg

SEQ ID NO: 2848 - RNA, 25 nt, Homo sapiens
gaagcaaagucuucuuuguucuuug

SEQ ID NO: 2849 - RNA, 25 nt, Homo sapiens
aaagucuucuuuguucuuugaggaa

SEQ ID NO: 2850 - RNA, 25 nt, Homo sapiens
ucuuuguucuuugaggaaaggagcc

SEQ ID NO: 2851 - RNA, 25 nt, Homo sapiens
aggcagaugaaaauuccuguuauua

SEQ ID NO: 2852 - RNA, 25 nt, Homo sapiens
guuauuaagguacaacuaaagcccg

SEQ ID NO: 2853 - RNA, 25 nt, Homo sapiens
auuaagguacaacuaaagcccgagg

SEQ ID NO: 2854 - RNA, 25 nt, Homo sapiens
uuaagguacaacuaaagcccgagga

SEQ ID NO: 2855 - RNA, 25 nt, Homo sapiens
gguacaacuaaagcccgaggagggu

SEQ ID NO: 2856 - RNA, 25 nt, Homo sapiens
guuccuccccauucucgcacagaga

SEQ ID NO: 2857 - RNA, 25 nt, Homo sapiens
aagugcuuaucaaaguuaauaucug

SEQ ID NO: 2858 - RNA, 25 nt, Homo sapiens
ccucugcagcagucgucacagaagc

SEQ ID NO: 2859 - RNA, 25 nt, Homo sapiens
ucgucacagaagcuggccccuuucc

SEQ ID NO: 2860 - RNA, 25 nt, Homo sapiens
cgucacagaagcuggccccuuuccu

SEQ ID NO: 2861 - RNA, 25 nt, Homo sapiens
uuucagaucagaagauccugucucu

SEQ ID NO: 2862 - RNA, 25 nt, Homo sapiens
uucagaucagaagauccugucucuc

SEQ ID NO: 2863 - RNA, 25 nt, Homo sapiens
cucucggguauaacuuuuuuuuuuu

SEQ ID NO: 2864 - RNA, 25 nt, Homo sapiens
agaaauacagugacucuccuaauua

SEQ ID NO: 2865 - RNA, 25 nt, Homo sapiens
ccacugauucagcagauauuccccc

SEQ ID NO: 2866 - RNA, 25 nt, Homo sapiens
agauauucccccaggcagauccuaa

SEQ ID NO: 2867 - RNA, 25 nt, Homo sapiens
agauccuaauggaaaccaacaugug

SEQ ID NO: 2868 - RNA, 25 nt, Homo sapiens
gaaaccaacaugugaggucugaugc

SEQ ID NO: 2869 - RNA, 25 nt, Homo sapiens
aaaccaacaugugaggucugaugcu

SEQ ID NO: 2870 - RNA, 25 nt, Homo sapiens
gcugggaauuuuaucaugcucaaca

SEQ ID NO: 2871 - RNA, 25 nt, Homo sapiens
cccacucaugccccagugcuuccgu

SEQ ID NO: 2872 - RNA, 25 nt, Homo sapiens
uuccguuggacacaugcgcauuuua

SEQ ID NO: 2873 - RNA, 25 nt, Homo sapiens
acacaugcgcauuuuacgguccugc

SEQ ID NO: 2874 - RNA, 25 nt, Homo sapiens
cacaugcgcauuuuacgguccugca

SEQ ID NO: 2875 - RNA, 25 nt, Homo sapiens
ggcuugaaagauuucugaccuucua

SEQ ID NO: 2876 - RNA, 25 nt, Homo sapiens
ucugaccuucuaagguccagugauu

SEQ ID NO: 2877 - RNA, 25 nt, Homo sapiens
agaagaggaagagguaccuuuugaa

SEQ ID NO: 2878 - RNA, 25 nt, Homo sapiens
gaagaggaagagguaccuuuugaau

SEQ ID NO: 2879 - RNA, 25 nt, Homo sapiens
aagaggaagagguaccuuuugaaug

SEQ ID NO: 2880 - RNA, 25 nt, Homo sapiens
cccuuacauaaccugaccacacaau

SEQ ID NO: 2881 - RNA, 25 nt, Homo sapiens
uuacauaaccugaccacacaauagg

SEQ ID NO: 2882 - RNA, 25 nt, Homo sapiens
cuuugcuucauuaaagugucugaga

SEQ ID NO: 2883 - RNA, 25 nt, Homo sapiens
uuaauaacaggaauuuucaucugcc

SEQ ID NO: 2884 - RNA, 25 nt, Homo sapiens
cgggcuuuaguuguaccuuaauaac

SEQ ID NO: 2885 - RNA, 25 nt, Homo sapiens
acaaaaugcagcuccuacccuccuc

SEQ ID NO: 2886 - RNA, 25 nt, Homo sapiens
aacaaaaugcagcuccuacccuccu

SEQ ID NO: 2887 - RNA, 25 nt, Homo sapiens
gugccuucucugugcgagaaugggg

SEQ ID NO: 2888 - RNA, 25 nt, Homo sapiens
ugagugccuucucugugcgagaaug

SEQ ID NO: 2889 - RNA, 25 nt, Homo sapiens
augagugccuucucugugcgagaau

SEQ ID NO: 2890 - RNA, 25 nt, Homo sapiens
aaugagugccuucucugugcgagaa

SEQ ID NO: 2891 - RNA, 25 nt, Homo sapiens
cuucugugacgacugcugcagaggc

SEQ ID NO: 2892 - RNA, 25 nt, Homo sapiens
ccagcuucugugacgacugcugcag

SEQ ID NO: 2893 - RNA, 25 nt, Homo sapiens
ucucagagcaguuagcccaggaaag

SEQ ID NO: 2894 - RNA, 25 nt, Homo sapiens
cucucagagcaguuagcccaggaaa

SEQ ID NO: 2895 - RNA, 25 nt, Homo sapiens
gcucucagagcaguuagcccaggaa

SEQ ID NO: 2896 - RNA, 25 nt, Homo sapiens
cuggugcucucagagcaguuagccc

SEQ ID NO: 2897 - RNA, 25 nt, Homo sapiens
gucauaucuaagucagauuucauuc

SEQ ID NO: 2898 - RNA, 25 nt, Homo sapiens
uguguagcuggcuucuucugaaaaa

SEQ ID NO: 2899 - RNA, 25 nt, Homo sapiens
auuuguucaucaagaguuguguagc

SEQ ID NO: 2900 - RNA, 25 nt, Homo sapiens
aaauucucugguuugugcucaucgu

SEQ ID NO: 2901 - RNA, 25 nt, Homo sapiens
aauuuucuucacuucugaaauucuc

SEQ ID NO: 2902 - RNA, 25 nt, Homo sapiens
aaaaaaaaaguuauacccgagagac

SEQ ID NO: 2903 - RNA, 25 nt, Homo sapiens
cugaacuaggaaauucaccauaauu

SEQ ID NO: 2904 - RNA, 25 nt, Homo sapiens
ugaaucaguggcucugagcugaacu

SEQ ID NO: 2905 - RNA, 25 nt, Homo sapiens
ccugggggaauaucugcugaaucag

SEQ ID NO: 2906 - RNA, 25 nt, Homo sapiens
uugguuuccauuaggaucugccugg

SEQ ID NO: 2907 - RNA, 25 nt, Homo sapiens
guugguuuccauuaggaucugccug

SEQ ID NO: 2908 - RNA, 25 nt, Homo sapiens
uguugguuuccauuaggaucugccu

SEQ ID NO: 2909 - RNA, 25 nt, Homo sapiens
auguugguuuccauuaggaucugcc

SEQ ID NO: 2910 - RNA, 25 nt, Homo sapiens
cagaccucacauguugguuuccauu

SEQ ID NO: 2911 - RNA, 25 nt, Homo sapiens
auucccagcaucagaccucacaugu

SEQ ID NO: 2912 - RNA, 25 nt, Homo sapiens
aaaagggaaaguggugaaggcaggg

SEQ ID NO: 2913 - RNA, 25 nt, Homo sapiens
gaaaaaagggaaaguggugaaggca

SEQ ID NO: 2914 - RNA, 25 nt, Homo sapiens
agaaaaaagggaaaguggugaaggc

SEQ ID NO: 2915 - RNA, 25 nt, Homo sapiens
gagaagaaaaaagggaaagugguga

SEQ ID NO: 2916 - RNA, 25 nt, Homo sapiens
ggguaagagaagaaaaaagggaaag

SEQ ID NO: 2917 - RNA, 25 nt, Homo sapiens
agaaagaggguaagagaagaaaaaa

SEQ ID NO: 2918 - RNA, 25 nt, Homo sapiens
cagaaagaggguaagagaagaaaaa

SEQ ID NO: 2919 - RNA, 25 nt, Homo sapiens
uggggaaggaauagaaacagaaaga

SEQ ID NO: 2920 - RNA, 25 nt, Homo sapiens
guggggaaggaauagaaacagaaag

SEQ ID NO: 2921 - RNA, 25 nt, Homo sapiens
ggaagcacuggggcaugagugggga

SEQ ID NO: 2922 - RNA, 25 nt, Homo sapiens
caacggaagcacuggggcaugagug

SEQ ID NO: 2923 - RNA, 25 nt, Homo sapiens
ccaacggaagcacuggggcaugagu

SEQ ID NO: 2924 - RNA, 25 nt, Homo sapiens
uccaacggaagcacuggggcaugag

SEQ ID NO: 2925 - RNA, 25 nt, Homo sapiens
gcgcauguguccaacggaagcacug

SEQ ID NO: 2926 - RNA, 25 nt, Homo sapiens
ugcgcauguguccaacggaagcacu

SEQ ID NO: 2927 - RNA, 25 nt, Homo sapiens
augcgcauguguccaacggaagcac

SEQ ID NO: 2928 - RNA, 25 nt, Homo sapiens
gaccguaaaaugcgcauguguccaa

SEQ ID NO: 2929 - RNA, 25 nt, Homo sapiens
aggucagaaaucuuucaagcccugc

SEQ ID NO: 2930 - RNA, 25 nt, Homo sapiens
ugauaccaaaucacuggaccuuaga

SEQ ID NO: 2931 - RNA, 25 nt, Homo sapiens
cuuagaucuucugauaccaaaucac

SEQ ID NO: 2932 - RNA, 25 nt, Homo sapiens
cacgcuucuuuaaauggcagagaga

SEQ ID NO: 2933 - RNA, 25 nt, Homo sapiens
ggaaauugcaacacgcuucuuuaaa

SEQ ID NO: 2934 - RNA, 25 nt, Homo sapiens
aggcgaaucacuuucacuucugcug

SEQ ID NO: 2935 - RNA, 25 nt, Homo sapiens
gaggcgaaucacuuucacuucugcu

SEQ ID NO: 2936 - RNA, 25 nt, Homo sapiens
agaggcgaaucacuuucacuucugc

SEQ ID NO: 2937 - RNA, 25 nt, Homo sapiens
acacggaaugcagacauuugaguag

SEQ ID NO: 2938 - RNA, 25 nt, Homo sapiens
aggguuugcuuucaccccauucaaa

SEQ ID NO: 2939 - RNA, 25 nt, Homo sapiens
ccuauuguguggucagguuauguaa

SEQ ID NO: 2940 - RNA, 25 nt, Homo sapiens
uccuauuguguggucagguuaugua

SEQ ID NO: 2941 - RNA, 25 nt, Homo sapiens
uuucauuuccuccuauugugugguc

SEQ ID NO: 2942 - RNA, 25 nt, Homo sapiens
cgggccuggcgcaacgcugagcagc

SEQ ID NO: 2943 - RNA, 25 nt, Homo sapiens
cgcugagcagcuggcgcgucccgcg

SEQ ID NO: 2944 - RNA, 25 nt, Homo sapiens
ggccccaguucugcgcagcuucccg

SEQ ID NO: 2945 - RNA, 25 nt, Homo sapiens
accagccgcgcuucuguccgccugc

SEQ ID NO: 2946 - RNA, 25 nt, Homo sapiens
gccgcgcuucuguccgccugcaggu

SEQ ID NO: 2947 - RNA, 25 nt, Homo sapiens
ccgcgcuucuguccgccugcaggua

SEQ ID NO: 2948 - RNA, 25 nt, Homo sapiens
gcagguagggagcguuguuccuccg

SEQ ID NO: 2949 - RNA, 25 nt, Homo sapiens
cagguagggagcguuguuccuccgc

SEQ ID NO: 2950 - RNA, 25 nt, Homo sapiens
cagcguugcgccaggcccggaggcg

SEQ ID NO: 2951 - RNA, 25 nt, Homo sapiens
ucagcguugcgccaggcccggaggc

SEQ ID NO: 2952 - RNA, 25 nt, Homo sapiens
cucagcguugcgccaggcccggagg

SEQ ID NO: 2953 - RNA, 25 nt, Homo sapiens
cugcucagcguugcgccaggcccgg

SEQ ID NO: 2954 - RNA, 25 nt, Homo sapiens
cagcugcucagcguugcgccaggcc

SEQ ID NO: 2955 - RNA, 25 nt, Homo sapiens
cgcgccagcugcucagcguugcgcc

SEQ ID NO: 2956 - RNA, 25 nt, Homo sapiens
aagcugcgcagaacuggggccgcgc

SEQ ID NO: 2957 - RNA, 25 nt, Homo sapiens
gaagcugcgcagaacuggggccgcg

SEQ ID NO: 2958 - RNA, 25 nt, Homo sapiens
agccucgggaagcugcgcagaacug

SEQ ID NO: 2959 - RNA, 25 nt, Homo sapiens
gagccucgggaagcugcgcagaacu

SEQ ID NO: 2960 - RNA, 25 nt, Homo sapiens
ggagccucgggaagcugcgcagaac

SEQ ID NO: 2961 - RNA, 25 nt, Homo sapiens
agaagcgcggcuggugcggagccuc

SEQ ID NO: 2962 - RNA, 25 nt, Homo sapiens
cagaagcgcggcuggugcggagccu

SEQ ID NO: 2963 - RNA, 25 nt, Homo sapiens
caggcggacagaagcgcggcuggug

SEQ ID NO: 2964 - RNA, 25 nt, Homo sapiens
accugcaggcggacagaagcgcggc

SEQ ID NO: 2965 - RNA, 25 nt, Homo sapiens
cccuaccugcaggcggacagaagcg

SEQ ID NO: 2966 - RNA, 25 nt, Homo sapiens
aggaacaacgcucccuaccugcagg

SEQ ID NO: 2967 - RNA, 25 nt, Homo sapiens
cggaggaacaacgcucccuaccugc

SEQ ID NO: 2968 - RNA, 25 nt, Homo sapiens
auaauuagggcauuccagaaagaug

SEQ ID NO: 2969 - RNA, 25 nt, Homo sapiens
ugcugucuuuauauucaugaccuac

SEQ ID NO: 2970 - RNA, 25 nt, Homo sapiens
ucaugaccuacuggcauuugcugaa

SEQ ID NO: 2971 - RNA, 25 nt, Homo sapiens
ucaucuuucuggaaugcccuaauua

SEQ ID NO: 2972 - RNA, 25 nt, Homo sapiens
aagacagcaaauauccucaucuuuc

SEQ ID NO: 2973 - RNA, 25 nt, Homo sapiens
gucuuaccguucagcaaaugccagu

SEQ ID NO: 2974 - RNA, 25 nt, Homo sapiens
ucuuucuuuuuagcauuuacuguca

SEQ ID NO: 2975 - RNA, 25 nt, Homo sapiens
uuagcauuuacugucacgguuccca

SEQ ID NO: 2976 - RNA, 25 nt, Homo sapiens
gucacgguucccaaggaccuauaug

SEQ ID NO: 2977 - RNA, 25 nt, Homo sapiens
ccaaggaccuauaugugguagagua

SEQ ID NO: 2978 - RNA, 25 nt, Homo sapiens
uucccaguagaaaaacaauuagacc

SEQ ID NO: 2979 - RNA, 25 nt, Homo sapiens
agaccuggcugcacuaauugucuau

SEQ ID NO: 2980 - RNA, 25 nt, Homo sapiens
gaccuggcugcacuaauugucuauu

SEQ ID NO: 2981 - RNA, 25 nt, Homo sapiens
gcugcacuaauugucuauugggaaa

SEQ ID NO: 2982 - RNA, 25 nt, Homo sapiens
gcacuaauugucuauugggaaaugg

SEQ ID NO: 2983 - RNA, 25 nt, Homo sapiens
auaagaacauuauucaauuugugca

SEQ ID NO: 2984 - RNA, 25 nt, Homo sapiens
aacauuauucaauuugugcauggag

SEQ ID NO: 2985 - RNA, 25 nt, Homo sapiens
uuugugcauggagaggaagaccuga

SEQ ID NO: 2986 - RNA, 25 nt, Homo sapiens
gguucagcauaguagcuacagacag

SEQ ID NO: 2987 - RNA, 25 nt, Homo sapiens
guucagcauaguagcuacagacaga

SEQ ID NO: 2988 - RNA, 25 nt, Homo sapiens
gcauaguagcuacagacagagggcc

SEQ ID NO: 2989 - RNA, 25 nt, Homo sapiens
uacagacagagggcccggcuguuga

SEQ ID NO: 2990 - RNA, 25 nt, Homo sapiens
cggcuguugaaggaccagcucuccc

SEQ ID NO: 2991 - RNA, 25 nt, Homo sapiens
ggcuguugaaggaccagcucucccu

SEQ ID NO: 2992 - RNA, 25 nt, Homo sapiens
cuucagaucacagaugugaaauugc

SEQ ID NO: 2993 - RNA, 25 nt, Homo sapiens
ucacagaugugaaauugcaggaugc

SEQ ID NO: 2994 - RNA, 25 nt, Homo sapiens
cacagaugugaaauugcaggaugca

SEQ ID NO: 2995 - RNA, 25 nt, Homo sapiens
acagaugugaaauugcaggaugcag

SEQ ID NO: 2996 - RNA, 25 nt, Homo sapiens
ggguguaccgcugcaugaucagcua

SEQ ID NO: 2997 - RNA, 25 nt, Homo sapiens
uguaccgcugcaugaucagcuaugg

SEQ ID NO: 2998 - RNA, 25 nt, Homo sapiens
acaagcgaauuacugugaaagucaa

SEQ ID NO: 2999 - RNA, 25 nt, Homo sapiens
aaugguaagaauuauuauagaugag

SEQ ID NO: 3000 - RNA, 25 nt, Homo sapiens
ugacaguaaaugcuaaaaagaaaga

SEQ ID NO: 3001 - RNA, 25 nt, Homo sapiens
cauacucuaccacauauagguccuu

SEQ ID NO: 3002 - RNA, 25 nt, Homo sapiens
ccauacucuaccacauauagguccu

SEQ ID NO: 3003 - RNA, 25 nt, Homo sapiens
auugcuaccauacucuaccacauau

SEQ ID NO: 3004 - RNA, 25 nt, Homo sapiens
agccaggucuaauuguuuuucuacu

SEQ ID NO: 3005 - RNA, 25 nt, Homo sapiens
cagccaggucuaauuguuuuucuac

SEQ ID NO: 3006 - RNA, 25 nt, Homo sapiens
uucccaauagacaauuagugcagcc

SEQ ID NO: 3007 - RNA, 25 nt, Homo sapiens
ucuguagcuacuaugcugaaccuuc

SEQ ID NO: 3008 - RNA, 25 nt, Homo sapiens
agggagagcugguccuucaacagcc

SEQ ID NO: 3009 - RNA, 25 nt, Homo sapiens
cagggagagcugguccuucaacagc

SEQ ID NO: 3010 - RNA, 25 nt, Homo sapiens
aagugcagcauuucccagggagagc

SEQ ID NO: 3011 - RNA, 25 nt, Homo sapiens
gugaucugaagugcagcauuuccca

SEQ ID NO: 3012 - RNA, 25 nt, Homo sapiens
ugugaucugaagugcagcauuuccc

SEQ ID NO: 3013 - RNA, 25 nt, Homo sapiens
ggcaccaccauagcugaucaugcag

SEQ ID NO: 3014 - RNA, 25 nt, Homo sapiens
acuuucacaguaauucgcuuguagu

SEQ ID NO: 3015 - RNA, 25 nt, Homo sapiens
uacaacaaaaucaaccaaagaauuu

SEQ ID NO: 3016 - RNA, 25 nt, Homo sapiens
aaaaucaaccaaagaauuuugguug

SEQ ID NO: 3017 - RNA, 25 nt, Homo sapiens
accucugaacaugaacugacauguc

SEQ ID NO: 3018 - RNA, 25 nt, Homo sapiens
gaacaugaacugacaugucaggcug

SEQ ID NO: 3019 - RNA, 25 nt, Homo sapiens
aacaugaacugacaugucaggcuga

SEQ ID NO: 3020 - RNA, 25 nt, Homo sapiens
acaugucaggcugagggcuacccca

SEQ ID NO: 3021 - RNA, 25 nt, Homo sapiens
gggcuaccccaaggccgaagucauc

SEQ ID NO: 3022 - RNA, 25 nt, Homo sapiens
caagcagugaccaucaaguccugag

SEQ ID NO: 3023 - RNA, 25 nt, Homo sapiens
accaccaccaccaauuccaagagag

SEQ ID NO: 3024 - RNA, 25 nt, Homo sapiens
uaaugagauuuucuacugcacuuuu

SEQ ID NO: 3025 - RNA, 25 nt, Homo sapiens
ugcacuuuuaggagauuagauccug

SEQ ID NO: 3026 - RNA, 25 nt, Homo sapiens
ccugaggaaaaccauacagcugaau

SEQ ID NO: 3027 - RNA, 25 nt, Homo sapiens
accauacagcugaauuggucauccc

SEQ ID NO: 3028 - RNA, 25 nt, Homo sapiens
uugguugauuuuguuguauggggcu

SEQ ID NO: 3029 - RNA, 25 nt, Homo sapiens
auucuuugguugauuuuguuguaug

SEQ ID NO: 3030 - RNA, 25 nt, Homo sapiens
aauucuuugguugauuuuguuguau

SEQ ID NO: 3031 - RNA, 25 nt, Homo sapiens
aaauucuuugguugauuuuguugua

SEQ ID NO: 3032 - RNA, 25 nt, Homo sapiens
gacuggauccacaaccaaaauucuu

SEQ ID NO: 3033 - RNA, 25 nt, Homo sapiens
augucaguucauguucagaggugac

SEQ ID NO: 3034 - RNA, 25 nt, Homo sapiens
gccugacaugucaguucauguucag

SEQ ID NO: 3035 - RNA, 25 nt, Homo sapiens
gcuuguccagaugacuucggccuug

SEQ ID NO: 3036 - RNA, 25 nt, Homo sapiens
ugcuuguccagaugacuucggccuu

SEQ ID NO: 3037 - RNA, 25 nt, Homo sapiens
cugcuuguccagaugacuucggccu

SEQ ID NO: 3038 - RNA, 25 nt, Homo sapiens
uggucacugcuuguccagaugacuu

SEQ ID NO: 3039 - RNA, 25 nt, Homo sapiens
gguggucuuaccacucaggacuuga

SEQ ID NO: 3040 - RNA, 25 nt, Homo sapiens
auugguggugguggucuuaccacuc

SEQ ID NO: 3041 - RNA, 25 nt, Homo sapiens
uccucucucuuggaauugguggugg

SEQ ID NO: 3042 - RNA, 25 nt, Homo sapiens
uucuccucucucuuggaauuggugg

SEQ ID NO: 3043 - RNA, 25 nt, Homo sapiens
agcuucuccucucucuuggaauugg

SEQ ID NO: 3044 - RNA, 25 nt, Homo sapiens
aaaagcuucuccucucucuuggaau

SEQ ID NO: 3045 - RNA, 25 nt, Homo sapiens
acauugaaaagcuucuccucucucu

SEQ ID NO: 3046 - RNA, 25 nt, Homo sapiens
guuguuguguugauucucagugugc

SEQ ID NO: 3047 - RNA, 25 nt, Homo sapiens
ccaauucagcuguaugguuuuccuc

SEQ ID NO: 3048 - RNA, 25 nt, Homo sapiens
accugggaugaccaauucagcugua

SEQ ID NO: 3049 - RNA, 25 nt, Homo sapiens
aauggacacauucagaauauuaccu

SEQ ID NO: 3050 - RNA, 25 nt, Homo sapiens
uaauggacacauucagaauauuacc

SEQ ID NO: 3051 - RNA, 25 nt, Homo sapiens
uuguuuuguuuuucagaacuaccuc

SEQ ID NO: 3052 - RNA, 25 nt, Homo sapiens
accucuggcacauccuccaaaugaa

SEQ ID NO: 3053 - RNA, 25 nt, Homo sapiens
cauccuccaaaugaaaggacucacu

SEQ ID NO: 3054 - RNA, 25 nt, Homo sapiens
aaugaaaggacucacuugguaauuc

SEQ ID NO: 3055 - RNA, 25 nt, Homo sapiens
augaaaggacucacuugguaauucu

SEQ ID NO: 3056 - RNA, 25 nt, Homo sapiens
uucugggagccaucuuauuaugccu

SEQ ID NO: 3057 - RNA, 25 nt, Homo sapiens
ugacauucaucuuccguuuaagaaa

SEQ ID NO: 3058 - RNA, 25 nt, Homo sapiens
aaagguaguauuuccuuaauugcag

SEQ ID NO: 3059 - RNA, 25 nt, Homo sapiens
uccuuucauuuggaggaugugccag

SEQ ID NO: 3060 - RNA, 25 nt, Homo sapiens
uuaccaagugaguccuuucauuugg

SEQ ID NO: 3061 - RNA, 25 nt, Homo sapiens
gaauuaccaagugaguccuuucauu

SEQ ID NO: 3062 - RNA, 25 nt, Homo sapiens
agugcuacaccaaggcauaauaaga

SEQ ID NO: 3063 - RNA, 25 nt, Homo sapiens
gaagaugaaugucagugcuacacca

SEQ ID NO: 3064 - RNA, 25 nt, Homo sapiens
uaaggaaauacuaccuuuucuuaaa

SEQ ID NO: 3065 - RNA, 25 nt, Homo sapiens
auuucuuuuucucaagggagaauga

SEQ ID NO: 3066 - RNA, 25 nt, Homo sapiens
ggagaaugauggaugugaaaaaaug

SEQ ID NO: 3067 - RNA, 25 nt, Homo sapiens
aagauacaaacucaaagaagcaaag

SEQ ID NO: 3068 - RNA, 25 nt, Homo sapiens
gaagcaaagugguaagaauaucaga

SEQ ID NO: 3069 - RNA, 25 nt, Homo sapiens
aagugguaagaauaucagaaggaau

SEQ ID NO: 3070 - RNA, 25 nt, Homo sapiens
agugguaagaauaucagaaggaauu

SEQ ID NO: 3071 - RNA, 25 nt, Homo sapiens
acuuugcuucuuugaguuuguaucu

SEQ ID NO: 3072 - RNA, 25 nt, Homo sapiens
uauuaucacucuccagauacacauu

SEQ ID NO: 3073 - RNA, 25 nt, Homo sapiens
uaucacucuccagauacacauuugg

SEQ ID NO: 3074 - RNA, 25 nt, Homo sapiens
auuuggaggagacguaauccagcau

SEQ ID NO: 3075 - RNA, 25 nt, Homo sapiens
gcauuggaacuucugaucuucaagc

SEQ ID NO: 3076 - RNA, 25 nt, Homo sapiens
cauuggaacuucugaucuucaagca

SEQ ID NO: 3077 - RNA, 25 nt, Homo sapiens
ucuucaagcagggauucucaaccug

SEQ ID NO: 3078 - RNA, 25 nt, Homo sapiens
agcagggauucucaaccugugguuu

SEQ ID NO: 3079 - RNA, 25 nt, Homo sapiens
gcagggauucucaaccugugguuua

SEQ ID NO: 3080 - RNA, 25 nt, Homo sapiens
cagggauucucaaccugugguuuag

SEQ ID NO: 3081 - RNA, 25 nt, Homo sapiens
cucaaccugugguuuagggguucau

SEQ ID NO: 3082 - RNA, 25 nt, Homo sapiens
ucaaccugugguuuagggguucauc

SEQ ID NO: 3083 - RNA, 25 nt, Homo sapiens
caaccugugguuuagggguucaucg

SEQ ID NO: 3084 - RNA, 25 nt, Homo sapiens
guucaucggggcugagcgugacaag

SEQ ID NO: 3085 - RNA, 25 nt, Homo sapiens
aucggggcugagcgugacaagagga

SEQ ID NO: 3086 - RNA, 25 nt, Homo sapiens
ggcugagcgugacaagaggaaggaa

SEQ ID NO: 3087 - RNA, 25 nt, Homo sapiens
gcugagcgugacaagaggaaggaau

SEQ ID NO: 3088 - RNA, 25 nt, Homo sapiens
gugacaagaggaaggaaugggcccg

SEQ ID NO: 3089 - RNA, 25 nt, Homo sapiens
ugacaagaggaaggaaugggcccgu

SEQ ID NO: 3090 - RNA, 25 nt, Homo sapiens
aggaaggaaugggcccgugggaugc

SEQ ID NO: 3091 - RNA, 25 nt, Homo sapiens
augggcccgugggaugcaggcaaug

SEQ ID NO: 3092 - RNA, 25 nt, Homo sapiens
ugggcccgugggaugcaggcaaugu

SEQ ID NO: 3093 - RNA, 25 nt, Homo sapiens
ggaugcaggcaaugugggacuuaaa

SEQ ID NO: 3094 - RNA, 25 nt, Homo sapiens
acuuaaaaggcccaagcacugaaaa

SEQ ID NO: 3095 - RNA, 25 nt, Homo sapiens
aggcccaagcacugaaaauggaacc

SEQ ID NO: 3096 - RNA, 25 nt, Homo sapiens
ugaaaauggaaccuggcgaaagcag

SEQ ID NO: 3097 - RNA, 25 nt, Homo sapiens
aaauggaaccuggcgaaagcagagg

SEQ ID NO: 3098 - RNA, 25 nt, Homo sapiens
agcagaggaggagaaugaagaaaga

SEQ ID NO: 3099 - RNA, 25 nt, Homo sapiens
agaaugaagaaagauggagucaaac

SEQ ID NO: 3100 - RNA, 25 nt, Homo sapiens
gaaugaagaaagauggagucaaaca

SEQ ID NO: 3101 - RNA, 25 nt, Homo sapiens
gaaagauggagucaaacagggagcc

SEQ ID NO: 3102 - RNA, 25 nt, Homo sapiens
agauggagucaaacagggagccugg

SEQ ID NO: 3103 - RNA, 25 nt, Homo sapiens
gauggagucaaacagggagccugga

SEQ ID NO: 3104 - RNA, 25 nt, Homo sapiens
agaccuugauacuuucaaaugccug

SEQ ID NO: 3105 - RNA, 25 nt, Homo sapiens
gaccuugauacuuucaaaugccuga

SEQ ID NO: 3106 - RNA, 25 nt, Homo sapiens
accuugauacuuucaaaugccugag

SEQ ID NO: 3107 - RNA, 25 nt, Homo sapiens
ugaggggcucaucgacgccugugac

SEQ ID NO: 3108 - RNA, 25 nt, Homo sapiens
gaggggcucaucgacgccugugaca

SEQ ID NO: 3109 - RNA, 25 nt, Homo sapiens
ucaucgacgccugugacagggagaa

SEQ ID NO: 3110 - RNA, 25 nt, Homo sapiens
cagggagaaaggauacuucugaaca

SEQ ID NO: 3111 - RNA, 25 nt, Homo sapiens
aagcaaaucauccauugcucauccu

SEQ ID NO: 3112 - RNA, 25 nt, Homo sapiens
ucauccauugcucauccuaggaaga

SEQ ID NO: 3113 - RNA, 25 nt, Homo sapiens
cauccauugcucauccuaggaagac

SEQ ID NO: 3114 - RNA, 25 nt, Homo sapiens
agacggguugagaaucccuaauuug

SEQ ID NO: 3115 - RNA, 25 nt, Homo sapiens
gacggguugagaaucccuaauuuga

SEQ ID NO: 3116 - RNA, 25 nt, Homo sapiens
ucugcaugacugagagucucagugu

SEQ ID NO: 3117 - RNA, 25 nt, Homo sapiens
augacugagagucucaguguuggaa

SEQ ID NO: 3118 - RNA, 25 nt, Homo sapiens
ugacugagagucucaguguuggaac

SEQ ID NO: 3119 - RNA, 25 nt, Homo sapiens
uuuuccuauuuauuuugagucugug

SEQ ID NO: 3120 - RNA, 25 nt, Homo sapiens
gugaggucuucuugucaugugagug

SEQ ID NO: 3121 - RNA, 25 nt, Homo sapiens
ugauuugcucacaucuaguaaaaca

SEQ ID NO: 3122 - RNA, 25 nt, Homo sapiens
ucuaguaaaacauggaguauuugua

SEQ ID NO: 3123 - RNA, 25 nt, Homo sapiens
aaacauggaguauuuguaaggugcu

SEQ ID NO: 3124 - RNA, 25 nt, Homo sapiens
cuccucuauaacuacaaguauacau

SEQ ID NO: 3125 - RNA, 25 nt, Homo sapiens
auuggaagcauaaagaucaaaccgu

SEQ ID NO: 3126 - RNA, 25 nt, Homo sapiens
auaaagaucaaaccguugguugcau

SEQ ID NO: 3127 - RNA, 25 nt, Homo sapiens
accuuuauuuaacccauuaauacuc

SEQ ID NO: 3128 - RNA, 25 nt, Homo sapiens
ggaaaacccgagcaguguugccaag

SEQ ID NO: 3129 - RNA, 25 nt, Homo sapiens
aaacccgagcaguguugccaagagg

SEQ ID NO: 3130 - RNA, 25 nt, Homo sapiens
agcaguguugccaagaggaggaaau

SEQ ID NO: 3131 - RNA, 25 nt, Homo sapiens
gccaagaggaggaaauaggccaaug

SEQ ID NO: 3132 - RNA, 25 nt, Homo sapiens
gaggaggaaauaggccaaugugguc

SEQ ID NO: 3133 - RNA, 25 nt, Homo sapiens
aggaggaaauaggccaauguggucu

SEQ ID NO: 3134 - RNA, 25 nt, Homo sapiens
ggaaauaggccaauguggucuggga

SEQ ID NO: 3135 - RNA, 25 nt, Homo sapiens
auaggccaauguggucugggacggu

SEQ ID NO: 3136 - RNA, 25 nt, Homo sapiens
cagaguaauuuucauuuacaaagag

SEQ ID NO: 3137 - RNA, 25 nt, Homo sapiens
guaauuuucauuuacaaagagaggu

SEQ ID NO: 3138 - RNA, 25 nt, Homo sapiens
uuaaaauaacccugaaaaauaacac

SEQ ID NO: 3139 - RNA, 25 nt, Homo sapiens
aucuaaugcuuguuuauauaguguc

SEQ ID NO: 3140 - RNA, 25 nt, Homo sapiens
auuuuaguguuucuuauauagcaga

SEQ ID NO: 3141 - RNA, 25 nt, Homo sapiens
cagauggaaugaauuugaaguuccc

SEQ ID NO: 3142 - RNA, 25 nt, Homo sapiens
agauggaaugaauuugaaguuccca

SEQ ID NO: 3143 - RNA, 25 nt, Homo sapiens
aaugaauuugaaguucccagggcug

SEQ ID NO: 3144 - RNA, 25 nt, Homo sapiens
ccaccauuuguuaaguauuugcucu

SEQ ID NO: 3145 - RNA, 25 nt, Homo sapiens
uaaguauuugcucuaggacagaguu

SEQ ID NO: 3146 - RNA, 25 nt, Homo sapiens
uuggauuuguuuauguuugcucaaa

SEQ ID NO: 3147 - RNA, 25 nt, Homo sapiens
uuauguuugcucaaaaggagaccca

SEQ ID NO: 3148 - RNA, 25 nt, Homo sapiens
uauguuugcucaaaaggagacccau

SEQ ID NO: 3149 - RNA, 25 nt, Homo sapiens
ucaaaaggagacccaugggcucucc

SEQ ID NO: 3150 - RNA, 25 nt, Homo sapiens
caaaaggagacccaugggcucucca

SEQ ID NO: 3151 - RNA, 25 nt, Homo sapiens
uaacucuguaugacagaaucauguc

SEQ ID NO: 3152 - RNA, 25 nt, Homo sapiens
uacuugcaaaaucacauuuucuuuc

SEQ ID NO: 3153 - RNA, 25 nt, Homo sapiens
aaucacauuuucuuucuggaaauuc

SEQ ID NO: 3154 - RNA, 25 nt, Homo sapiens
gucaucacuacacagcccuccuaag

SEQ ID NO: 3155 - RNA, 25 nt, Homo sapiens
uacacagcccuccuaagaggcuucc

SEQ ID NO: 3156 - RNA, 25 nt, Homo sapiens
acagcccuccuaagaggcuuccugg

SEQ ID NO: 3157 - RNA, 25 nt, Homo sapiens
uggagguuucgagauucagaugccc

SEQ ID NO: 3158 - RNA, 25 nt, Homo sapiens
ggagguuucgagauucagaugcccu

SEQ ID NO: 3159 - RNA, 25 nt, Homo sapiens
agaucccagaguuuccuuucccucu

SEQ ID NO: 3160 - RNA, 25 nt, Homo sapiens
uuuccuuucccucuuggccauauuc

SEQ ID NO: 3161 - RNA, 25 nt, Homo sapiens
uggccauauucuggugucaaugaca

SEQ ID NO: 3162 - RNA, 25 nt, Homo sapiens
cuggugucaaugacaaggaguaccu

SEQ ID NO: 3163 - RNA, 25 nt, Homo sapiens
aguaccuuggcuuugccacauguca

SEQ ID NO: 3164 - RNA, 25 nt, Homo sapiens
uguacaugugcauuuguacaguaau

SEQ ID NO: 3165 - RNA, 25 nt, Homo sapiens
ugacaguguucuuugugugaauuac

SEQ ID NO: 3166 - RNA, 25 nt, Homo sapiens
uugugugaauuacaggcaagaauug

SEQ ID NO: 3167 - RNA, 25 nt, Homo sapiens
uacaggcaagaauuguggcugagca

SEQ ID NO: 3168 - RNA, 25 nt, Homo sapiens
auuccuaaguccuaacuccuccuug

SEQ ID NO: 3169 - RNA, 25 nt, Homo sapiens
aaguccuaacuccuccuuguggugu

SEQ ID NO: 3170 - RNA, 25 nt, Homo sapiens
uccuccuugugguguuggauuugua

SEQ ID NO: 3171 - RNA, 25 nt, Homo sapiens
cuuuugucucauguuucaucguaaa

SEQ ID NO: 3172 - RNA, 25 nt, Homo sapiens
ucucauguuucaucguaaauggcau

SEQ ID NO: 3173 - RNA, 25 nt, Homo sapiens
aaauauucuuauuuauuuuguuacu

SEQ ID NO: 3174 - RNA, 25 nt, Homo sapiens
uaaaauguucaguuuaacaucccag

SEQ ID NO: 3175 - RNA, 25 nt, Homo sapiens
uaacaucccaguggagaaaguuacu

SEQ ID NO: 3176 - RNA, 25 nt, Homo sapiens
auuacgucuccuccaaauguguauc

SEQ ID NO: 3177 - RNA, 25 nt, Homo sapiens
gcuugaagaucagaaguuccaaugc

SEQ ID NO: 3178 - RNA, 25 nt, Homo sapiens
cagccccgaugaaccccuaaaccac

SEQ ID NO: 3179 - RNA, 25 nt, Homo sapiens
aagucccacauugccugcaucccac

SEQ ID NO: 3180 - RNA, 25 nt, Homo sapiens
uaagucccacauugccugcauccca

SEQ ID NO: 3181 - RNA, 25 nt, Homo sapiens
ucgccagguuccauuuucagugcuu

SEQ ID NO: 3182 - RNA, 25 nt, Homo sapiens
uucgccagguuccauuuucagugcu

SEQ ID NO: 3183 - RNA, 25 nt, Homo sapiens
uucauucuccuccucugcuuucgcc

SEQ ID NO: 3184 - RNA, 25 nt, Homo sapiens
uuugaaaguaucaaggucucccucc

SEQ ID NO: 3185 - RNA, 25 nt, Homo sapiens
gccccucaggcauuugaaaguauca

SEQ ID NO: 3186 - RNA, 25 nt, Homo sapiens
ugucacaggcgucgaugagccccuc

SEQ ID NO: 3187 - RNA, 25 nt, Homo sapiens
cagaaguauccuuucucccugucac

SEQ ID NO: 3188 - RNA, 25 nt, Homo sapiens
gaugagcaauggaugauuugcuugg

SEQ ID NO: 3189 - RNA, 25 nt, Homo sapiens
uaggaugagcaauggaugauuugcu

SEQ ID NO: 3190 - RNA, 25 nt, Homo sapiens
caacccgucuuccuaggaugagcaa

SEQ ID NO: 3191 - RNA, 25 nt, Homo sapiens
uuagggauucucaacccgucuuccu

SEQ ID NO: 3192 - RNA, 25 nt, Homo sapiens
ucugcaggaacugacccucaaauua

SEQ ID NO: 3193 - RNA, 25 nt, Homo sapiens
uucugcaggaacugacccucaaauu

SEQ ID NO: 3194 - RNA, 25 nt, Homo sapiens
gaguggaggcaaagggcacuucugc

SEQ ID NO: 3195 - RNA, 25 nt, Homo sapiens
aauugaggcauugaguggaggcaaa

SEQ ID NO: 3196 - RNA, 25 nt, Homo sapiens
aaauugaggcauugaguggaggcaa

SEQ ID NO: 3197 - RNA, 25 nt, Homo sapiens
gaaaacaaauugaggcauugagugg

SEQ ID NO: 3198 - RNA, 25 nt, Homo sapiens
gcagaaaacaaauugaggcauugag

SEQ ID NO: 3199 - RNA, 25 nt, Homo sapiens
ucucagucaugcagaaaacaaauug

SEQ ID NO: 3200 - RNA, 25 nt, Homo sapiens
aagaccucacagacucaaaauaaau

SEQ ID NO: 3201 - RNA, 25 nt, Homo sapiens
aaaucauuaagcagcaaguuuaguu

SEQ ID NO: 3202 - RNA, 25 nt, Homo sapiens
uuccaauguauacuuguaguuauag

SEQ ID NO: 3203 - RNA, 25 nt, Homo sapiens
uaaaggugacauccuaugcaaccaa

SEQ ID NO: 3204 - RNA, 25 nt, Homo sapiens
accagaguauuaauggguuaaauaa

SEQ ID NO: 3205 - RNA, 25 nt, Homo sapiens
agauuaggucaaccagaguauuaau

SEQ ID NO: 3206 - RNA, 25 nt, Homo sapiens
aagauuaggucaaccagaguauuaa

SEQ ID NO: 3207 - RNA, 25 nt, Homo sapiens
acacuugaggucugagaauaagauu

SEQ ID NO: 3208 - RNA, 25 nt, Homo sapiens
ccuugucuaacugcacagacacuug

SEQ ID NO: 3209 - RNA, 25 nt, Homo sapiens
auauagcuguaaauuguauuauaaa

SEQ ID NO: 3210 - RNA, 25 nt, Homo sapiens
accacauuggccuauuuccuccucu

SEQ ID NO: 3211 - RNA, 25 nt, Homo sapiens
uauauccaaccgucccagaccacau

SEQ ID NO: 3212 - RNA, 25 nt, Homo sapiens
aaaggaauuccaguguuauuuuuca

SEQ ID NO: 3213 - RNA, 25 nt, Homo sapiens
aaaaggaauuccaguguuauuuuuc

SEQ ID NO: 3214 - RNA, 25 nt, Homo sapiens
ucaggaauaaauauaaugcuagaaa

SEQ ID NO: 3215 - RNA, 25 nt, Homo sapiens
uuagauuauauggcaaaggcaaauc

SEQ ID NO: 3216 - RNA, 25 nt, Homo sapiens
aaacaagcauuagauuauauggcaa

SEQ ID NO: 3217 - RNA, 25 nt, Homo sapiens
cuauauaaacaagcauuagauuaua

SEQ ID NO: 3218 - RNA, 25 nt, Homo sapiens
ccuuuccauacuuaaauuuuuuuag

SEQ ID NO: 3219 - RNA, 25 nt, Homo sapiens
aaagaaggcauggauccucagcccu

SEQ ID NO: 3220 - RNA, 25 nt, Homo sapiens
caaagaaggcauggauccucagccc

SEQ ID NO: 3221 - RNA, 25 nt, Homo sapiens
agauaacuuagaaacaaagaaggca

SEQ ID NO: 3222 - RNA, 25 nt, Homo sapiens
gggaaagauaacuuagaaacaaaga

SEQ ID NO: 3223 - RNA, 25 nt, Homo sapiens
cauaugaaagauaaugaaaagcuau

SEQ ID NO: 3224 - RNA, 25 nt, Homo sapiens
ucauaugaaagauaaugaaaagcua

SEQ ID NO: 3225 - RNA, 25 nt, Homo sapiens
uauguaggacauauuuaacauauac

SEQ ID NO: 3226 - RNA, 25 nt, Homo sapiens
auggugguugucuaaauguauaugu

SEQ ID NO: 3227 - RNA, 25 nt, Homo sapiens
ccuagagcaaauacuuaacaaaugg

SEQ ID NO: 3228 - RNA, 25 nt, Homo sapiens
uguccuagagcaaauacuuaacaaa

SEQ ID NO: 3229 - RNA, 25 nt, Homo sapiens
acucagugcacccuggagagcccau

SEQ ID NO: 3230 - RNA, 25 nt, Homo sapiens
gacucagugcacccuggagagccca

SEQ ID NO: 3231 - RNA, 25 nt, Homo sapiens
aggacuagauugacucagugcaccc

SEQ ID NO: 3232 - RNA, 25 nt, Homo sapiens
agaguuaauaauaagauugcuuuuu

SEQ ID NO: 3233 - RNA, 25 nt, Homo sapiens
guagcuagcagucaagguacacugc

SEQ ID NO: 3234 - RNA, 25 nt, Homo sapiens
ucuggcacaggguagcuagcaguca

SEQ ID NO: 3235 - RNA, 25 nt, Homo sapiens
caacgaaugaggcuuuucuggcaca

SEQ ID NO: 3236 - RNA, 25 nt, Homo sapiens
acaacgaaugaggcuuuucuggcac

SEQ ID NO: 3237 - RNA, 25 nt, Homo sapiens
ucaagcacaacgaaugaggcuuuuc

SEQ ID NO: 3238 - RNA, 25 nt, Homo sapiens
uucaaggguucaagcacaacgaaug

SEQ ID NO: 3239 - RNA, 25 nt, Homo sapiens
agugaugacagcugguggcauucaa

SEQ ID NO: 3240 - RNA, 25 nt, Homo sapiens
uagugaugacagcugguggcauuca

SEQ ID NO: 3241 - RNA, 25 nt, Homo sapiens
agggcuguguagugaugacagcugg

SEQ ID NO: 3242 - RNA, 25 nt, Homo sapiens
aggagggcuguguagugaugacagc

SEQ ID NO: 3243 - RNA, 25 nt, Homo sapiens
gaaaccuccaggaagccucuuagga

SEQ ID NO: 3244 - RNA, 25 nt, Homo sapiens
cgaaaccuccaggaagccucuuagg

SEQ ID NO: 3245 - RNA, 25 nt, Homo sapiens
ucucgaaaccuccaggaagccucuu

SEQ ID NO: 3246 - RNA, 25 nt, Homo sapiens
agggcaucugaaucucgaaaccucc

SEQ ID NO: 3247 - RNA, 25 nt, Homo sapiens
ggaaaggaaacucugggaucuccca

SEQ ID NO: 3248 - RNA, 25 nt, Homo sapiens
gggaaaggaaacucugggaucuccc

SEQ ID NO: 3249 - RNA, 25 nt, Homo sapiens
auggccaagagggaaaggaaacucu

SEQ ID NO: 3250 - RNA, 25 nt, Homo sapiens
uauggccaagagggaaaggaaacuc

SEQ ID NO: 3251 - RNA, 25 nt, Homo sapiens
acaccagaauauggccaagagggaa

SEQ ID NO: 3252 - RNA, 25 nt, Homo sapiens
cauugacaccagaauauggccaaga

SEQ ID NO: 3253 - RNA, 25 nt, Homo sapiens
ucauugacaccagaauauggccaag

SEQ ID NO: 3254 - RNA, 25 nt, Homo sapiens
acuccuugucauugacaccagaaua

SEQ ID NO: 3255 - RNA, 25 nt, Homo sapiens
ucagccuugacauguggcaaagcca

SEQ ID NO: 3256 - RNA, 25 nt, Homo sapiens
acacuguuucuucagccuugacaug

SEQ ID NO: 3257 - RNA, 25 nt, Homo sapiens
aaacagauaacacaaggagcucugu

SEQ ID NO: 3258 - RNA, 25 nt, Homo sapiens
ugcacauguacaaacagauaacaca

SEQ ID NO: 3259 - RNA, 25 nt, Homo sapiens
acaccacaaggaggaguuaggacuu

SEQ ID NO: 3260 - RNA, 25 nt, Homo sapiens
aaauccaacaccacaaggaggaguu

SEQ ID NO: 3261 - RNA, 25 nt, Homo sapiens
gccuuacaaauccaacaccacaagg

SEQ ID NO: 3262 - RNA, 25 nt, Homo sapiens
agugccuuacaaauccaacaccaca

SEQ ID NO: 3263 - RNA, 25 nt, Homo sapiens
auuuacgaugaaacaugagacaaaa

SEQ ID NO: 3264 - RNA, 25 nt, Homo sapiens
cauuuacgaugaaacaugagacaaa

SEQ ID NO: 3265 - RNA, 25 nt, Homo sapiens
aaaagugacaaucaaaugcagaauu

SEQ ID NO: 3266 - RNA, 25 nt, Homo sapiens
uaagaauauuuuauuaaauuaaugc

SEQ ID NO: 3267 - RNA, 25 nt, Homo sapiens
aaaauaaacaagaaaauggacaugc

SEQ ID NO: 3268 - RNA, 25 nt, Homo sapiens
auuaaacacaaaauaaacaagaaaa

SEQ ID NO: 3269 - RNA, 25 nt, Homo sapiens
aauauuccaaguaacuuucuccacu

SEQ ID NO: 3270 - RNA, 25 nt, Homo sapiens
aaauauuccaaguaacuuucuccac

SEQ ID NO: 3271 - RNA, 25 nt, Homo sapiens
uauaccgucuugaaauuuaaguuua

SEQ ID NO: 3272 - RNA, 25 nt, Homo sapiens
aaguuuagggaccacucucugucaa

SEQ ID NO: 3273 - RNA, 25 nt, Homo sapiens
cacucucugucaaaggauccagcgc

SEQ ID NO: 3274 - RNA, 25 nt, Homo sapiens
cagcgcugguaauauagauugcuga

SEQ ID NO: 3275 - RNA, 25 nt, Homo sapiens
ugaaggccuuugccuucuuuccacc

SEQ ID NO: 3276 - RNA, 25 nt, Homo sapiens
uucugugaaaaauauagcuucaguu

SEQ ID NO: 3277 - RNA, 25 nt, Homo sapiens
caguuugguccacgaauacagaagu

SEQ ID NO: 3278 - RNA, 25 nt, Homo sapiens
uuucaagcacacaacaagcaaaacu

SEQ ID NO: 3279 - RNA, 25 nt, Homo sapiens
caaucaaaugcacuucguuuuuccc

SEQ ID NO: 3280 - RNA, 25 nt, Homo sapiens
aaucaaaugcacuucguuuuucccu

SEQ ID NO: 3281 - RNA, 25 nt, Homo sapiens
agcuccugccacaucucagcccugc

SEQ ID NO: 3282 - RNA, 25 nt, Homo sapiens
gcuccugccacaucucagcccugca

SEQ ID NO: 3283 - RNA, 25 nt, Homo sapiens
ucagcccugcagggcagucuucaua

SEQ ID NO: 3284 - RNA, 25 nt, Homo sapiens
cagcccugcagggcagucuucauaa

SEQ ID NO: 3285 - RNA, 25 nt, Homo sapiens
cagucuucauaagggagacaaaaga

SEQ ID NO: 3286 - RNA, 25 nt, Homo sapiens
agucuucauaagggagacaaaagaa

SEQ ID NO: 3287 - RNA, 25 nt, Homo sapiens
gggagacaaaagaagggcuaugcac

SEQ ID NO: 3288 - RNA, 25 nt, Homo sapiens
agggcuaugcacuggcacugacagu

SEQ ID NO: 3289 - RNA, 25 nt, Homo sapiens
gggcuaugcacuggcacugacaguu

SEQ ID NO: 3290 - RNA, 25 nt, Homo sapiens
uaugcacuggcacugacaguugggc

SEQ ID NO: 3291 - RNA, 25 nt, Homo sapiens
aauaagccuaaaucucaacauucca

SEQ ID NO: 3292 - RNA, 25 nt, Homo sapiens
auaagccuaaaucucaacauuccaa

SEQ ID NO: 3293 - RNA, 25 nt, Homo sapiens
cauuccaagggaaucuucaagauca

SEQ ID NO: 3294 - RNA, 25 nt, Homo sapiens
ggaaucuucaagaucaagguagacc

SEQ ID NO: 3295 - RNA, 25 nt, Homo sapiens
gguccagucaucucuuaaucuuuua

SEQ ID NO: 3296 - RNA, 25 nt, Homo sapiens
uccaucucaaaaacaaaaaacaaaa

SEQ ID NO: 3297 - RNA, 25 nt, Homo sapiens
ccaucucaaaaacaaaaaacaaaaa

SEQ ID NO: 3298 - RNA, 25 nt, Homo sapiens
gaucacagaucucuuugaaaaucag

SEQ ID NO: 3299 - RNA, 25 nt, Homo sapiens
uuucccuaguuuaucugaaguuuca

SEQ ID NO: 3300 - RNA, 25 nt, Homo sapiens
ggacauaugaugugcccgaauuucc

SEQ ID NO: 3301 - RNA, 25 nt, Homo sapiens
ucuaacauccaugauuaacagucuc

SEQ ID NO: 3302 - RNA, 25 nt, Homo sapiens
cuaacauccaugauuaacagucucu

SEQ ID NO: 3303 - RNA, 25 nt, Homo sapiens
cauccaugauuaacagucucugggu

SEQ ID NO: 3304 - RNA, 25 nt, Homo sapiens
auccaugauuaacagucucuggguu

SEQ ID NO: 3305 - RNA, 25 nt, Homo sapiens
cagucucuggguuggguaacucugu

SEQ ID NO: 3306 - RNA, 25 nt, Homo sapiens
gguaacucuguuggcuuaaauacag

SEQ ID NO: 3307 - RNA, 25 nt, Homo sapiens
ugacaugccuguuuaaguucagugc

SEQ ID NO: 3308 - RNA, 25 nt, Homo sapiens
caugugagucauuaucuucugaaaa

SEQ ID NO: 3309 - RNA, 25 nt, Homo sapiens
augugagucauuaucuucugaaaau

SEQ ID NO: 3310 - RNA, 25 nt, Homo sapiens
augggaaaacucugcuccauagcag

SEQ ID NO: 3311 - RNA, 25 nt, Homo sapiens
guggacagaaccuccaaaaccaguc

SEQ ID NO: 3312 - RNA, 25 nt, Homo sapiens
agacaaaacaccaagcucaaaaaua

SEQ ID NO: 3313 - RNA, 25 nt, Homo sapiens
caaaacaccaagcucaaaaauaagg

SEQ ID NO: 3314 - RNA, 25 nt, Homo sapiens
acaccaagcucaaaaauaagguggu

SEQ ID NO: 3315 - RNA, 25 nt, Homo sapiens
cucaaaaauaaggugguuggaucua

SEQ ID NO: 3316 - RNA, 25 nt, Homo sapiens
auggcauugcaaagcgacaacccaa

SEQ ID NO: 3317 - RNA, 25 nt, Homo sapiens
gcaaagcgacaacccaaagguugug

SEQ ID NO: 3318 - RNA, 25 nt, Homo sapiens
caaagcgacaacccaaagguuguga

SEQ ID NO: 3319 - RNA, 25 nt, Homo sapiens
cugcugacauagcaauaauacucau

SEQ ID NO: 3320 - RNA, 25 nt, Homo sapiens
ugcugacauagcaauaauacucauu

SEQ ID NO: 3321 - RNA, 25 nt, Homo sapiens
uccacuucauauacguucucuucaa

SEQ ID NO: 3322 - RNA, 25 nt, Homo sapiens
ucugcuacugcauuugccaauccug

SEQ ID NO: 3323 - RNA, 25 nt, Homo sapiens
cugcuacugcauuugccaauccuga

SEQ ID NO: 3324 - RNA, 25 nt, Homo sapiens
cuacugcauuugccaauccugaggg

SEQ ID NO: 3325 - RNA, 25 nt, Homo sapiens
uacugcauuugccaauccugaggga

SEQ ID NO: 3326 - RNA, 25 nt, Homo sapiens
ugcauuugccaauccugagggaggg

SEQ ID NO: 3327 - RNA, 25 nt, Homo sapiens
uuugccaauccugagggagggaggu

SEQ ID NO: 3328 - RNA, 25 nt, Homo sapiens
gggagggagguuggccaaagagaug

SEQ ID NO: 3329 - RNA, 25 nt, Homo sapiens
gagguuggccaaagagaugaggcug

SEQ ID NO: 3330 - RNA, 25 nt, Homo sapiens
augaggcuguggaaauaaaguguug

SEQ ID NO: 3331 - RNA, 25 nt, Homo sapiens
cagcgcuggauccuuugacagagag

SEQ ID NO: 3332 - RNA, 25 nt, Homo sapiens
cuucagcaaucuauauuaccagcgc

SEQ ID NO: 3333 - RNA, 25 nt, Homo sapiens
cuguugccugguggaaagaaggcaa

SEQ ID NO: 3334 - RNA, 25 nt, Homo sapiens
caaauucuguugccugguggaaaga

SEQ ID NO: 3335 - RNA, 25 nt, Homo sapiens
cggggacacaaauucuguugccugg

SEQ ID NO: 3336 - RNA, 25 nt, Homo sapiens
ugacggggacacaaauucuguugcc

SEQ ID NO: 3337 - RNA, 25 nt, Homo sapiens
uuucacagaagaagaagcagugacg

SEQ ID NO: 3338 - RNA, 25 nt, Homo sapiens
uuuucacagaagaagaagcagugac

SEQ ID NO: 3339 - RNA, 25 nt, Homo sapiens
uuuuucacagaagaagaagcaguga

SEQ ID NO: 3340 - RNA, 25 nt, Homo sapiens
uaucucugaccaacuucuguauucg

SEQ ID NO: 3341 - RNA, 25 nt, Homo sapiens
cgaagugcauuugauugguguguau

SEQ ID NO: 3342 - RNA, 25 nt, Homo sapiens
cagggaaaaacgaagugcauuugau

SEQ ID NO: 3343 - RNA, 25 nt, Homo sapiens
ggcugagauguggcaggagcuccca

SEQ ID NO: 3344 - RNA, 25 nt, Homo sapiens
gggcugagauguggcaggagcuccc

SEQ ID NO: 3345 - RNA, 25 nt, Homo sapiens
cugcccugcagggcugagauguggc

SEQ ID NO: 3346 - RNA, 25 nt, Homo sapiens
aagacugcccugcagggcugagaug

SEQ ID NO: 3347 - RNA, 25 nt, Homo sapiens
ucucccuuaugaagacugcccugca

SEQ ID NO: 3348 - RNA, 25 nt, Homo sapiens
gucucccuuaugaagacugcccugc

SEQ ID NO: 3349 - RNA, 25 nt, Homo sapiens
agauucccuuggaauguugagauuu

SEQ ID NO: 3350 - RNA, 25 nt, Homo sapiens
ucuaccuugaucuugaagauucccu

SEQ ID NO: 3351 - RNA, 25 nt, Homo sapiens
uaaaagauuaagagaugacuggacc

SEQ ID NO: 3352 - RNA, 25 nt, Homo sapiens
gauccuuaaaagauuaagagaugac

SEQ ID NO: 3353 - RNA, 25 nt, Homo sapiens
cuuuuuuggcacagaaagucuaaag

SEQ ID NO: 3354 - RNA, 25 nt, Homo sapiens
acuuuuuuggcacagaaagucuaaa

SEQ ID NO: 3355 - RNA, 25 nt, Homo sapiens
aacuuuuuuggcacagaaagucuaa

SEQ ID NO: 3356 - RNA, 25 nt, Homo sapiens
ugcugaggugaaagcauaacuuuuu

SEQ ID NO: 3357 - RNA, 25 nt, Homo sapiens
auaaacuagggaaaacugggugcug

SEQ ID NO: 3358 - RNA, 25 nt, Homo sapiens
aacuucagauaaacuagggaaaacu

SEQ ID NO: 3359 - RNA, 25 nt, Homo sapiens
aaacuucagauaaacuagggaaaac

SEQ ID NO: 3360 - RNA, 25 nt, Homo sapiens
uguccaugaaacuucagauaaacua

SEQ ID NO: 3361 - RNA, 25 nt, Homo sapiens
auguccaugaaacuucagauaaacu

SEQ ID NO: 3362 - RNA, 25 nt, Homo sapiens
gggucucuggagcuccaggaaauuc

SEQ ID NO: 3363 - RNA, 25 nt, Homo sapiens
ggggucucuggagcuccaggaaauu

SEQ ID NO: 3364 - RNA, 25 nt, Homo sapiens
cuugacguggggucucuggagcucc

SEQ ID NO: 3365 - RNA, 25 nt, Homo sapiens
cuaggaauucuugacguggggucuc

SEQ ID NO: 3366 - RNA, 25 nt, Homo sapiens
auauacacuaggaauucuugacgug

SEQ ID NO: 3367 - RNA, 25 nt, Homo sapiens
uauauacacuaggaauucuugacgu

SEQ ID NO: 3368 - RNA, 25 nt, Homo sapiens
uuauauacacuaggaauucuugacg

SEQ ID NO: 3369 - RNA, 25 nt, Homo sapiens
gcucaaacgggcuuuuauauacacu

SEQ ID NO: 3370 - RNA, 25 nt, Homo sapiens
uaaucauggauguuagagcucaaac

SEQ ID NO: 3371 - RNA, 25 nt, Homo sapiens
uuaaucauggauguuagagcucaaa

SEQ ID NO: 3372 - RNA, 25 nt, Homo sapiens
uacccaacccagagacuguuaauca

SEQ ID NO: 3373 - RNA, 25 nt, Homo sapiens
acugggaccugcacugaacuuaaac

SEQ ID NO: 3374 - RNA, 25 nt, Homo sapiens
uaaugacucacaugggaauugaacu

SEQ ID NO: 3375 - RNA, 25 nt, Homo sapiens
auaaugacucacaugggaauugaac

SEQ ID NO: 3376 - RNA, 25 nt, Homo sapiens
auuuucagaagauaaugacucacau

SEQ ID NO: 3377 - RNA, 25 nt, Homo sapiens
cauuuucagaagauaaugacucaca

SEQ ID NO: 3378 - RNA, 25 nt, Homo sapiens
guuuuggagguucuguccacugcua

SEQ ID NO: 3379 - RNA, 25 nt, Homo sapiens
agcugugucaccugacugguuuugg

SEQ ID NO: 3380 - RNA, 25 nt, Homo sapiens
augagcugugucaccugacugguuu

SEQ ID NO: 3381 - RNA, 25 nt, Homo sapiens
gaaacuaugagcugugucaccugac

SEQ ID NO: 3382 - RNA, 25 nt, Homo sapiens
gauccaaccaccuuauuuuugagcu

SEQ ID NO: 3383 - RNA, 25 nt, Homo sapiens
gcaggcagcaacccucacaaccuuu

SEQ ID NO: 3384 - RNA, 25 nt, Homo sapiens
agcaggcagcaacccucacaaccuu

SEQ ID NO: 3385 - RNA, 25 nt, Homo sapiens
ugaguauuauugcuaugucagcagc

SEQ ID NO: 3386 - RNA, 25 nt, Homo sapiens
auugaagagaacguauaugaagugg

SEQ ID NO: 3387 - RNA, 25 nt, Homo sapiens
accauugaagagaacguauaugaag

SEQ ID NO: 3388 - RNA, 25 nt, Homo sapiens
caggauuggcaaaugcaguagcaga

SEQ ID NO: 3389 - RNA, 25 nt, Homo sapiens
ucaggauuggcaaaugcaguagcag

SEQ ID NO: 3390 - RNA, 25 nt, Homo sapiens
uuggccaaccucccucccucaggau

SEQ ID NO: 3391 - RNA, 25 nt, Homo sapiens
ucucuuuggccaaccucccucccuc

SEQ ID NO: 3392 - RNA, 25 nt, Homo sapiens
cuuuauuuccacagccucaucucuu

SEQ ID NO: 3393 - RNA, 25 nt, Homo sapiens
ucuuugcuaugagaauacccuagua

SEQ ID NO: 3394 - RNA, 25 nt, Homo sapiens
cuuugcuaugagaauacccuaguaa

SEQ ID NO: 3395 - RNA, 25 nt, Homo sapiens
uuugcuaugagaauacccuaguaag

SEQ ID NO: 3396 - RNA, 25 nt, Homo sapiens
uugcuaugagaauacccuaguaagg

SEQ ID NO: 3397 - RNA, 25 nt, Homo sapiens
aagguaagaauaauggaaugggguu

SEQ ID NO: 3398 - RNA, 25 nt, Homo sapiens
uaagguaagaauaauggaauggggu

SEQ ID NO: 3399 - RNA, 25 nt, Homo sapiens
aauuuaagguaagaauaauggaaug

SEQ ID NO: 3400 - RNA, 25 nt, Homo sapiens
gaauuuaagguaagaauaauggaau

SEQ ID NO: 3401 - RNA, 25 nt, Homo sapiens
agaauuuaagguaagaauaauggaa

SEQ ID NO: 3402 - RNA, 25 nt, Homo sapiens
gauacagaauuuaagguaagaauaa

SEQ ID NO: 3403 - RNA, 25 nt, Homo sapiens
uagcaaagagaagauacagaauuua

SEQ ID NO: 3404 - RNA, 25 nt, Homo sapiens
gcuccgauguagaugccuauucuga

SEQ ID NO: 3405 - RNA, 25 nt, Homo sapiens
guugcuccagagucccguaagucau

SEQ ID NO: 3406 - RNA, 25 nt, Homo sapiens
gccaaucuagagucccguaacucau

SEQ ID NO: 3407 - RNA, 25 nt, Homo sapiens
gagucccguaacucauuggccaaug

SEQ ID NO: 3408 - RNA, 25 nt, Homo sapiens
cauuggccaauguggauauuugcua

SEQ ID NO: 3409 - RNA, 25 nt, Homo sapiens
ggauauuugcuauggaaacacaaac

SEQ ID NO: 3410 - RNA, 25 nt, Homo sapiens
cugggcuggcucuggcucuuaucuu

SEQ ID NO: 3411 - RNA, 25 nt, Homo sapiens
gcagggaucugugcugggcuggcuc

SEQ ID NO: 3412 - RNA, 25 nt, Homo sapiens
aucggagcagggaucugugcugggc

SEQ ID NO: 3413 - RNA, 25 nt, Homo sapiens
cuacaucggagcagggaucugugcu

SEQ ID NO: 3414 - RNA, 25 nt, Homo sapiens
ucuacaucggagcagggaucugugc

SEQ ID NO: 3415 - RNA, 25 nt, Homo sapiens
cagaauaggcaucuacaucggagca

SEQ ID NO: 3416 - RNA, 25 nt, Homo sapiens
ucagaauaggcaucuacaucggagc

SEQ ID NO: 3417 - RNA, 25 nt, Homo sapiens
caaccaucagaauaggcaucuacau

SEQ ID NO: 3418 - RNA, 25 nt, Homo sapiens
gggacucuggagcaaccaucagaau

SEQ ID NO: 3419 - RNA, 25 nt, Homo sapiens
gauuggccaaugacuuacgggacuc

SEQ ID NO: 3420 - RNA, 25 nt, Homo sapiens
gacucuagauuggccaaugacuuac

SEQ ID NO: 3421 - RNA, 25 nt, Homo sapiens
ggacucuagauuggccaaugacuua

SEQ ID NO: 3422 - RNA, 25 nt, Homo sapiens
gccaaugaguuacgggacucuagau

SEQ ID NO: 3423 - RNA, 25 nt, Homo sapiens
auauccacauuggccaaugaguuac

SEQ ID NO: 3424 - RNA, 25 nt, Homo sapiens
aauauccacauuggccaaugaguua

SEQ ID NO: 3425 - RNA, 25 nt, Homo sapiens
guguuuccauagcaaauauccacau

SEQ ID NO: 3426 - RNA, 25 nt, Homo sapiens
aguuacuuacuguuagauuuauauc

SEQ ID NO: 3427 - RNA, 25 nt, Homo sapiens
guuacuuacuguuagauuuauauca

SEQ ID NO: 3428 - RNA, 25 nt, Homo sapiens
acuuacuguuagauuuauaucaggg

SEQ ID NO: 3429 - RNA, 25 nt, Homo sapiens
uuuuauagcagagacacagacacug

SEQ ID NO: 3430 - RNA, 25 nt, Homo sapiens
auuuuauagcagagacacagacacu

SEQ ID NO: 3431 - RNA, 25 nt, Homo sapiens
gauuuuauagcagagacacagacac

SEQ ID NO: 3432 - RNA, 25 nt, Homo sapiens
cuccucugccccaugcauaguuacc

SEQ ID NO: 3433 - RNA, 25 nt, Homo sapiens
uccucugccccaugcauaguuaccu

SEQ ID NO: 3434 - RNA, 25 nt, Homo sapiens
gcauaguuaccugggccaugucccc

SEQ ID NO: 3435 - RNA, 25 nt, Homo sapiens
uaguuaccugggccauguccccugg

SEQ ID NO: 3436 - RNA, 25 nt, Homo sapiens
cauguccccuggugguaagcauccu

SEQ ID NO: 3437 - RNA, 25 nt, Homo sapiens
ccccuggugguaagcauccuuggaa

SEQ ID NO: 3438 - RNA, 25 nt, Homo sapiens
cugcagugaagucucucugccgagu

SEQ ID NO: 3439 - RNA, 25 nt, Homo sapiens
ugaagucucucugccgagucggugc

SEQ ID NO: 3440 - RNA, 25 nt, Homo sapiens
gaagucucucugccgagucggugca

SEQ ID NO: 3441 - RNA, 25 nt, Homo sapiens
aagucucucugccgagucggugcag

SEQ ID NO: 3442 - RNA, 25 nt, Homo sapiens
ugccgagucggugcaggggugaccu

SEQ ID NO: 3443 - RNA, 25 nt, Homo sapiens
cuuggcuaaugucagaaacaacaua

SEQ ID NO: 3444 - RNA, 25 nt, Homo sapiens
cagguaacuaugcauggggcagagg

SEQ ID NO: 3445 - RNA, 25 nt, Homo sapiens
gcccagguaacuaugcauggggcag

SEQ ID NO: 3446 - RNA, 25 nt, Homo sapiens
gacauggcccagguaacuaugcaug

SEQ ID NO: 3447 - RNA, 25 nt, Homo sapiens
ggacauggcccagguaacuaugcau

SEQ ID NO: 3448 - RNA, 25 nt, Homo sapiens
gggacauggcccagguaacuaugca

SEQ ID NO: 3449 - RNA, 25 nt, Homo sapiens
ugcuuaccaccaggggacauggccc

SEQ ID NO: 3450 - RNA, 25 nt, Homo sapiens
caaggaugcuuaccaccaggggaca

SEQ ID NO: 3451 - RNA, 25 nt, Homo sapiens
ccuuuccaaggaugcuuaccaccag

SEQ ID NO: 3452 - RNA, 25 nt, Homo sapiens
gccuuuccaaggaugcuuaccacca

SEQ ID NO: 3453 - RNA, 25 nt, Homo sapiens
agccuuuccaaggaugcuuaccacc

SEQ ID NO: 3454 - RNA, 25 nt, Homo sapiens
gagagacuucacugcagccuuucca

SEQ ID NO: 3455 - RNA, 25 nt, Homo sapiens
agccaaggucaccccugcaccgacu

SEQ ID NO: 3456 - RNA, 25 nt, Homo sapiens
cuuauguuguuucugacauuagcca

SEQ ID NO: 3457 - RNA, 25 nt, Homo sapiens
gauggcaugcaaauguccacucacc

SEQ ID NO: 3458 - RNA, 25 nt, Homo sapiens
cucaccugguuugaugaccaacuuc

SEQ ID NO: 3459 - RNA, 25 nt, Homo sapiens
uaaauuuuucaucauucauuaugcc

SEQ ID NO: 3460 - RNA, 25 nt, Homo sapiens
aaauuuuucaucauucauuaugccu

SEQ ID NO: 3461 - RNA, 25 nt, Homo sapiens
uucaucauucauuaugccugggauu

SEQ ID NO: 3462 - RNA, 25 nt, Homo sapiens
auucauuaugccugggauuuggauc

SEQ ID NO: 3463 - RNA, 25 nt, Homo sapiens
cugucugcuagagucacauucucua

SEQ ID NO: 3464 - RNA, 25 nt, Homo sapiens
ugcuagagucacauucucuaugguc

SEQ ID NO: 3465 - RNA, 25 nt, Homo sapiens
gcuagagucacauucucuaugguca

SEQ ID NO: 3466 - RNA, 25 nt, Homo sapiens
uauggucagggacacaucuccuuug

SEQ ID NO: 3467 - RNA, 25 nt, Homo sapiens
cggaaauccccauuuagccaguauc

SEQ ID NO: 3468 - RNA, 25 nt, Homo sapiens
gcaccacguugccacauucaaacac

SEQ ID NO: 3469 - RNA, 25 nt, Homo sapiens
acguugccacauucaaacacaggac

SEQ ID NO: 3470 - RNA, 25 nt, Homo sapiens
ggacaggcuccuuugccccagcaga

SEQ ID NO: 3471 - RNA, 25 nt, Homo sapiens
gacaggcuccuuugccccagcagac

SEQ ID NO: 3472 - RNA, 25 nt, Homo sapiens
uccuuugccccagcagacgggcacg

SEQ ID NO: 3473 - RNA, 25 nt, Homo sapiens
cccagcagacgggcacgagguuccc

SEQ ID NO: 3474 - RNA, 25 nt, Homo sapiens
ccagcagacgggcacgagguucccu

SEQ ID NO: 3475 - RNA, 25 nt, Homo sapiens
cagcagacgggcacgagguucccug

SEQ ID NO: 3476 - RNA, 25 nt, Homo sapiens
cagacgggcacgagguucccugggg

SEQ ID NO: 3477 - RNA, 25 nt, Homo sapiens
cgggcacgagguucccuggggcggc

SEQ ID NO: 3478 - RNA, 25 nt, Homo sapiens
gggcacgagguucccuggggcggcu

SEQ ID NO: 3479 - RNA, 25 nt, Homo sapiens
ggcacgagguucccuggggcggcug

SEQ ID NO: 3480 - RNA, 25 nt, Homo sapiens
ccuggggcggcugggguguagaagc

SEQ ID NO: 3481 - RNA, 25 nt, Homo sapiens
cuggggcggcugggguguagaagca

SEQ ID NO: 3482 - RNA, 25 nt, Homo sapiens
gcugggguguagaagcagggcagau

SEQ ID NO: 3483 - RNA, 25 nt, Homo sapiens
accuccgcucuguauuccacuucug

SEQ ID NO: 3484 - RNA, 25 nt, Homo sapiens
ucugaggacccugcauagagagaga

SEQ ID NO: 3485 - RNA, 25 nt, Homo sapiens
gaaguuggucaucaaaccaggugag

SEQ ID NO: 3486 - RNA, 25 nt, Homo sapiens
uuaaccugaaguuggucaucaaacc

SEQ ID NO: 3487 - RNA, 25 nt, Homo sapiens
aaugaugaaaaauuuaaccugaagu

SEQ ID NO: 3488 - RNA, 25 nt, Homo sapiens
ucuacugcugccggauccaaauccc

SEQ ID NO: 3489 - RNA, 25 nt, Homo sapiens
agcagacagugggaucuacugcugc

SEQ ID NO: 3490 - RNA, 25 nt, Homo sapiens
agagaaugugacucuagcagacagu

SEQ ID NO: 3491 - RNA, 25 nt, Homo sapiens
uagagaaugugacucuagcagacag

SEQ ID NO: 3492 - RNA, 25 nt, Homo sapiens
acuggcuaaauggggauuuccgcaa

SEQ ID NO: 3493 - RNA, 25 nt, Homo sapiens
uggacauccagauacuggcuaaaug

SEQ ID NO: 3494 - RNA, 25 nt, Homo sapiens
uuggacauccagauacuggcuaaau

SEQ ID NO: 3495 - RNA, 25 nt, Homo sapiens
auuggacauccagauacuggcuaaa

SEQ ID NO: 3496 - RNA, 25 nt, Homo sapiens
ugugaauuauuggacauccagauac

SEQ ID NO: 3497 - RNA, 25 nt, Homo sapiens
gacugaugaaagggaugugaauuau

SEQ ID NO: 3498 - RNA, 25 nt, Homo sapiens
aacguggugcucaggacugaugaaa

SEQ ID NO: 3499 - RNA, 25 nt, Homo sapiens
caacguggugcucaggacugaugaa

SEQ ID NO: 3500 - RNA, 25 nt, Homo sapiens
guuugaauguggcaacguggugcuc

SEQ ID NO: 3501 - RNA, 25 nt, Homo sapiens
uguccuguguuugaauguggcaacg

SEQ ID NO: 3502 - RNA, 25 nt, Homo sapiens
aaggagccuguccuguguuugaaug

SEQ ID NO: 3503 - RNA, 25 nt, Homo sapiens
accucgugcccgucugcuggggcaa

SEQ ID NO: 3504 - RNA, 25 nt, Homo sapiens
cagggaaccucgugcccgucugcug

SEQ ID NO: 3505 - RNA, 25 nt, Homo sapiens
ccagggaaccucgugcccgucugcu

SEQ ID NO: 3506 - RNA, 25 nt, Homo sapiens
cccagggaaccucgugcccgucugc

SEQ ID NO: 3507 - RNA, 25 nt, Homo sapiens
cugcuucuacaccccagccgcccca

SEQ ID NO: 3508 - RNA, 25 nt, Homo sapiens
ccugcuucuacaccccagccgcccc

SEQ ID NO: 3509 - RNA, 25 nt, Homo sapiens
cagaaguggaauacagagcggaggu

SEQ ID NO: 3510 - RNA, 25 nt, Homo sapiens
uccucagaaguggaauacagagcgg

SEQ ID NO: 3511 - RNA, 25 nt, Homo sapiens
ggguccucagaaguggaauacagag

SEQ ID NO: 3512 - RNA, 25 nt, Homo sapiens
ucucucuaugcaggguccucagaag

SEQ ID NO: 3513 - RNA, 25 nt, Homo sapiens
agcagcagcagcaggacacagucaa

SEQ ID NO: 3514 - RNA, 25 nt, Homo sapiens
gcagcagcagcaggacacagucaaa

SEQ ID NO: 3515 - RNA, 25 nt, Homo sapiens
cagucaaagggaagaugugaaaaca

SEQ ID NO: 3516 - RNA, 25 nt, Homo sapiens
auggagcuugcagaagaaaagucag

SEQ ID NO: 3517 - RNA, 25 nt, Homo sapiens
agaaaagucagaggacaccucuguu

SEQ ID NO: 3518 - RNA, 25 nt, Homo sapiens
uuaggcacaguuuuaacucuccaaa

SEQ ID NO: 3519 - RNA, 25 nt, Homo sapiens
cacaguuuuaacucuccaaauggac

SEQ ID NO: 3520 - RNA, 25 nt, Homo sapiens
acaguuuuaacucuccaaauggacu

SEQ ID NO: 3521 - RNA, 25 nt, Homo sapiens
ccacugagugcuagcucagcacacc

SEQ ID NO: 3522 - RNA, 25 nt, Homo sapiens
cacugagugcuagcucagcacaccc

SEQ ID NO: 3523 - RNA, 25 nt, Homo sapiens
cagugauucuuauaguaacacugcc

SEQ ID NO: 3524 - RNA, 25 nt, Homo sapiens
acugccaggucuacagucacauuaa

SEQ ID NO: 3525 - RNA, 25 nt, Homo sapiens
cgacgaugaugauacaaguaagucu

SEQ ID NO: 3526 - RNA, 25 nt, Homo sapiens
ggagaguuaaaacugugccuaacag

SEQ ID NO: 3527 - RNA, 25 nt, Homo sapiens
aguuggaagaaguacccaguccauu

SEQ ID NO: 3528 - RNA, 25 nt, Homo sapiens
cucaugugauuguggaguagacagu

SEQ ID NO: 3529 - RNA, 25 nt, Homo sapiens
ggggcggcuacugcucaugugauug

SEQ ID NO: 3530 - RNA, 25 nt, Homo sapiens
gugcugagcuagcacucaguggggg

SEQ ID NO: 3531 - RNA, 25 nt, Homo sapiens
ggugugcugagcuagcacucagugg

SEQ ID NO: 3532 - RNA, 25 nt, Homo sapiens
gggugugcugagcuagcacucagug

SEQ ID NO: 3533 - RNA, 25 nt, Homo sapiens
cgggugugcugagcuagcacucagu

SEQ ID NO: 3534 - RNA, 25 nt, Homo sapiens
ccgggugugcugagcuagcacucag

SEQ ID NO: 3535 - RNA, 25 nt, Homo sapiens
aagaaucacuggcaaucagacaccc

SEQ ID NO: 3536 - RNA, 25 nt, Homo sapiens
uaagaaucacuggcaaucagacacc

SEQ ID NO: 3537 - RNA, 25 nt, Homo sapiens
cuggcaguguuacuauaagaaucac

SEQ ID NO: 3538 - RNA, 25 nt, Homo sapiens
guuuccuuuaaugugacuguagacc

SEQ ID NO: 3539 - RNA, 25 nt, Homo sapiens
uguaguguggcaugacagagaacuu

SEQ ID NO: 3540 - RNA, 25 nt, Homo sapiens
gaacacuuacaggauguguguagug

SEQ ID NO: 3541 - RNA, 25 nt, Homo sapiens
acaggacagacaucagaacacuuac

SEQ ID NO: 3542 - RNA, 25 nt, Homo sapiens
ggaagguggagggaaggccgggcac

SEQ ID NO: 3543 - RNA, 25 nt, Homo sapiens
gaagguggagggaaggccgggcaca

SEQ ID NO: 3544 - RNA, 25 nt, Homo sapiens
aagguggagggaaggccgggcacag

SEQ ID NO: 3545 - RNA, 25 nt, Homo sapiens
gagggaaggccgggcacagggguga

SEQ ID NO: 3546 - RNA, 25 nt, Homo sapiens
ggugaaggcccagagaccagcagaa

SEQ ID NO: 3547 - RNA, 25 nt, Homo sapiens
cagcagaacggcaucccagccacga

SEQ ID NO: 3548 - RNA, 25 nt, Homo sapiens
acuuugcucugucugcucuccgcca

SEQ ID NO: 3549 - RNA, 25 nt, Homo sapiens
uccgccacggcccugcucuguuccc

SEQ ID NO: 3550 - RNA, 25 nt, Homo sapiens
ccgccacggcccugcucuguucccu

SEQ ID NO: 3551 - RNA, 25 nt, Homo sapiens
gggacacccccgcccccaccuccuc

SEQ ID NO: 3552 - RNA, 25 nt, Homo sapiens
ucugcccagcuuuccagcuuuccuc

SEQ ID NO: 3553 - RNA, 25 nt, Homo sapiens
agcuuuccagcuuuccucuggauuc

SEQ ID NO: 3554 - RNA, 25 nt, Homo sapiens
cagcuuuccucuggauuccggccuc

SEQ ID NO: 3555 - RNA, 25 nt, Homo sapiens
gucaucccuccccacccucucucca

SEQ ID NO: 3556 - RNA, 25 nt, Homo sapiens
ccacccucucuccaaggcccucucc

SEQ ID NO: 3557 - RNA, 25 nt, Homo sapiens
ccccuuuccuuuucugaccuccuuu

SEQ ID NO: 3558 - RNA, 25 nt, Homo sapiens
cuuuccuuuucugaccuccuuuugg

SEQ ID NO: 3559 - RNA, 25 nt, Homo sapiens
uuuccuuuucugaccuccuuuugga

SEQ ID NO: 3560 - RNA, 25 nt, Homo sapiens
gagggcucagcgcugcccagaccau

SEQ ID NO: 3561 - RNA, 25 nt, Homo sapiens
cgcugcccagaccauaggagagaug

SEQ ID NO: 3562 - RNA, 25 nt, Homo sapiens
gcugcccagaccauaggagagaugu

SEQ ID NO: 3563 - RNA, 25 nt, Homo sapiens
gcccagaccauaggagagauguggg

SEQ ID NO: 3564 - RNA, 25 nt, Homo sapiens
ggagagaugugggaggcucaguucc

SEQ ID NO: 3565 - RNA, 25 nt, Homo sapiens
gagagaugugggaggcucaguuccu

SEQ ID NO: 3566 - RNA, 25 nt, Homo sapiens
gggcuugcuguuucugcagccgcuu

SEQ ID NO: 3567 - RNA, 25 nt, Homo sapiens
ggcuugcuguuucugcagccgcuuu

SEQ ID NO: 3568 - RNA, 25 nt, Homo sapiens
uugcuguuucugcagccgcuuuggg

SEQ ID NO: 3569 - RNA, 25 nt, Homo sapiens
uucugcagccgcuuuggguggcucc

SEQ ID NO: 3570 - RNA, 25 nt, Homo sapiens
ccgcuuuggguggcuccagguaaaa

SEQ ID NO: 3571 - RNA, 25 nt, Homo sapiens
cgcuuuggguggcuccagguaaaac

SEQ ID NO: 3572 - RNA, 25 nt, Homo sapiens
gcuuuggguggcuccagguaaaacg

SEQ ID NO: 3573 - RNA, 25 nt, Homo sapiens
uggguggcuccagguaaaacgggga

SEQ ID NO: 3574 - RNA, 25 nt, Homo sapiens
guggcuccagguaaaacggggaugg

SEQ ID NO: 3575 - RNA, 25 nt, Homo sapiens
uggcuccagguaaaacggggauggc

SEQ ID NO: 3576 - RNA, 25 nt, Homo sapiens
cuccagguaaaacggggauggcggg

SEQ ID NO: 3577 - RNA, 25 nt, Homo sapiens
uccagguaaaacggggauggcggga

SEQ ID NO: 3578 - RNA, 25 nt, Homo sapiens
gucucugggccuucaccccugugcc

SEQ ID NO: 3579 - RNA, 25 nt, Homo sapiens
cugggaugccguucugcuggucucu

SEQ ID NO: 3580 - RNA, 25 nt, Homo sapiens
gcugggaugccguucugcuggucuc

SEQ ID NO: 3581 - RNA, 25 nt, Homo sapiens
cgucguggcugggaugccguucugc

SEQ ID NO: 3582 - RNA, 25 nt, Homo sapiens
acagagcaaaguggccgucguggcu

SEQ ID NO: 3583 - RNA, 25 nt, Homo sapiens
gacagagcaaaguggccgucguggc

SEQ ID NO: 3584 - RNA, 25 nt, Homo sapiens
agcagacagagcaaaguggccgucg

SEQ ID NO: 3585 - RNA, 25 nt, Homo sapiens
guggcggagagcagacagagcaaag

SEQ ID NO: 3586 - RNA, 25 nt, Homo sapiens
cccagggaacagagcagggccgugg

SEQ ID NO: 3587 - RNA, 25 nt, Homo sapiens
ugucccagggaacagagcagggccg

SEQ ID NO: 3588 - RNA, 25 nt, Homo sapiens
cgggggugucccagggaacagagca

SEQ ID NO: 3589 - RNA, 25 nt, Homo sapiens
gcgggggugucccagggaacagagc

SEQ ID NO: 3590 - RNA, 25 nt, Homo sapiens
aggaggugggggcggggguguccca

SEQ ID NO: 3591 - RNA, 25 nt, Homo sapiens
gaggaggugggggcggggguguccc

SEQ ID NO: 3592 - RNA, 25 nt, Homo sapiens
aggcagccugaggaggugggggcgg

SEQ ID NO: 3593 - RNA, 25 nt, Homo sapiens
caggcagccugaggaggugggggcg

SEQ ID NO: 3594 - RNA, 25 nt, Homo sapiens
ucaggcagccugaggaggugggggc

SEQ ID NO: 3595 - RNA, 25 nt, Homo sapiens
aucaggcagccugaggagguggggg

SEQ ID NO: 3596 - RNA, 25 nt, Homo sapiens
cagaucaggcagccugaggaggugg

SEQ ID NO: 3597 - RNA, 25 nt, Homo sapiens
gcagaucaggcagccugaggaggug

SEQ ID NO: 3598 - RNA, 25 nt, Homo sapiens
ggcagaucaggcagccugaggaggu

SEQ ID NO: 3599 - RNA, 25 nt, Homo sapiens
gggcagaucaggcagccugaggagg

SEQ ID NO: 3600 - RNA, 25 nt, Homo sapiens
gcugggcagaucaggcagccugagg

SEQ ID NO: 3601 - RNA, 25 nt, Homo sapiens
aaagcugggcagaucaggcagccug

SEQ ID NO: 3602 - RNA, 25 nt, Homo sapiens
ggaaagcuggaaagcugggcagauc

SEQ ID NO: 3603 - RNA, 25 nt, Homo sapiens
gaauccagaggaaagcuggaaagcu

SEQ ID NO: 3604 - RNA, 25 nt, Homo sapiens
ggaauccagaggaaagcuggaaagc

SEQ ID NO: 3605 - RNA, 25 nt, Homo sapiens
cagaggccggaauccagaggaaagc

SEQ ID NO: 3606 - RNA, 25 nt, Homo sapiens
gggaugaccagaggccggaauccag

SEQ ID NO: 3607 - RNA, 25 nt, Homo sapiens
aggguggggagggaugaccagaggc

SEQ ID NO: 3608 - RNA, 25 nt, Homo sapiens
agagaggguggggagggaugaccag

SEQ ID NO: 3609 - RNA, 25 nt, Homo sapiens
gagggccuuggagagagggugggga

SEQ ID NO: 3610 - RNA, 25 nt, Homo sapiens
agagggccuuggagagagggugggg

SEQ ID NO: 3611 - RNA, 25 nt, Homo sapiens
aggagagggccuuggagagagggug

SEQ ID NO: 3612 - RNA, 25 nt, Homo sapiens
caggagagggccuuggagagagggu

SEQ ID NO: 3613 - RNA, 25 nt, Homo sapiens
ccaggagagggccuuggagagaggg

SEQ ID NO: 3614 - RNA, 25 nt, Homo sapiens
agaccaggagagggccuuggagaga

SEQ ID NO: 3615 - RNA, 25 nt, Homo sapiens
gagaccaggagagggccuuggagag

SEQ ID NO: 3616 - RNA, 25 nt, Homo sapiens
aagaagggagaccaggagagggccu

SEQ ID NO: 3617 - RNA, 25 nt, Homo sapiens
uucuagaagaagggagaccaggaga

SEQ ID NO: 3618 - RNA, 25 nt, Homo sapiens
guucuagaagaagggagaccaggag

SEQ ID NO: 3619 - RNA, 25 nt, Homo sapiens
aagggguucuagaagaagggagacc

SEQ ID NO: 3620 - RNA, 25 nt, Homo sapiens
gguggaggaagggguucuagaagaa

SEQ ID NO: 3621 - RNA, 25 nt, Homo sapiens
agguggaggaagggguucuagaaga

SEQ ID NO: 3622 - RNA, 25 nt, Homo sapiens
ucugcagagagggagguggaggaag

SEQ ID NO: 3623 - RNA, 25 nt, Homo sapiens
uucugcagagagggagguggaggaa

SEQ ID NO: 3624 - RNA, 25 nt, Homo sapiens
guucugcagagagggagguggagga

SEQ ID NO: 3625 - RNA, 25 nt, Homo sapiens
agaaguucugcagagagggaggugg

SEQ ID NO: 3626 - RNA, 25 nt, Homo sapiens
aggagaaguucugcagagagggagg

SEQ ID NO: 3627 - RNA, 25 nt, Homo sapiens
uaaaggagaaguucugcagagaggg

SEQ ID NO: 3628 - RNA, 25 nt, Homo sapiens
ggguaaaggagaaguucugcagaga

SEQ ID NO: 3629 - RNA, 25 nt, Homo sapiens
gggguaaaggagaaguucugcagag

SEQ ID NO: 3630 - RNA, 25 nt, Homo sapiens
ggcagugguggggggugggggguaa

SEQ ID NO: 3631 - RNA, 25 nt, Homo sapiens
aaagggggcaguggugggggguggg

SEQ ID NO: 3632 - RNA, 25 nt, Homo sapiens
gaaagggggcagugguggggggugg

SEQ ID NO: 3633 - RNA, 25 nt, Homo sapiens
ggaaagggggcagugguggggggug

SEQ ID NO: 3634 - RNA, 25 nt, Homo sapiens
aggaaagggggcagugguggggggu

SEQ ID NO: 3635 - RNA, 25 nt, Homo sapiens
aaggaaagggggcaguggugggggg

SEQ ID NO: 3636 - RNA, 25 nt, Homo sapiens
gaaaaggaaagggggcagugguggg

SEQ ID NO: 3637 - RNA, 25 nt, Homo sapiens
agaaaaggaaagggggcaguggugg

SEQ ID NO: 3638 - RNA, 25 nt, Homo sapiens
cagaaaaggaaagggggcaguggug

SEQ ID NO: 3639 - RNA, 25 nt, Homo sapiens
ucagaaaaggaaagggggcaguggu

SEQ ID NO: 3640 - RNA, 25 nt, Homo sapiens
gucagaaaaggaaagggggcagugg

SEQ ID NO: 3641 - RNA, 25 nt, Homo sapiens
gaggucagaaaaggaaagggggcag

SEQ ID NO: 3642 - RNA, 25 nt, Homo sapiens
caaaaggaggucagaaaaggaaagg

SEQ ID NO: 3643 - RNA, 25 nt, Homo sapiens
ccaaaaggaggucagaaaaggaaag

SEQ ID NO: 3644 - RNA, 25 nt, Homo sapiens
uccaaaaggaggucagaaaaggaaa

SEQ ID NO: 3645 - RNA, 25 nt, Homo sapiens
cuccaaaaggaggucagaaaaggaa

SEQ ID NO: 3646 - RNA, 25 nt, Homo sapiens
gagcccuccaaaaggaggucagaaa

SEQ ID NO: 3647 - RNA, 25 nt, Homo sapiens
gggcagcgcugagcccuccaaaagg

SEQ ID NO: 3648 - RNA, 25 nt, Homo sapiens
ucugggcagcgcugagcccuccaaa

SEQ ID NO: 3649 - RNA, 25 nt, Homo sapiens
gccucccacaucucuccuauggucu

SEQ ID NO: 3650 - RNA, 25 nt, Homo sapiens
agccucccacaucucuccuaugguc

SEQ ID NO: 3651 - RNA, 25 nt, Homo sapiens
aacugagccucccacaucucuccua

SEQ ID NO: 3652 - RNA, 25 nt, Homo sapiens
aagcggcugcagaaacagcaagccc

SEQ ID NO: 3653 - RNA, 25 nt, Homo sapiens
ccguuuuaccuggagccacccaaag

SEQ ID NO: 3654 - RNA, 25 nt, Homo sapiens
acccucccgccauccccguuuuacc

SEQ ID NO: 3655 - RNA, 25 nt, Homo sapiens
cucaccuagugaagccucuccagcc

SEQ ID NO: 3656 - RNA, 25 nt, Homo sapiens
ucaccuagugaagccucuccagcca

SEQ ID NO: 3657 - RNA, 25 nt, Homo sapiens
caccuagugaagccucuccagccag

SEQ ID NO: 3658 - RNA, 25 nt, Homo sapiens
gugaagccucuccagccaggggcug

SEQ ID NO: 3659 - RNA, 25 nt, Homo sapiens
ccucuccagccaggggcugaggucc

SEQ ID NO: 3660 - RNA, 25 nt, Homo sapiens
cuccagccaggggcugaggucccgg

SEQ ID NO: 3661 - RNA, 25 nt, Homo sapiens
gccaggggcugaggucccgguggug

SEQ ID NO: 3662 - RNA, 25 nt, Homo sapiens
ccaggggcugaggucccgguggugu

SEQ ID NO: 3663 - RNA, 25 nt, Homo sapiens
gcugaggucccgguggugugggccc

SEQ ID NO: 3664 - RNA, 25 nt, Homo sapiens
gaggucccgguggugugggcccagg

SEQ ID NO: 3665 - RNA, 25 nt, Homo sapiens
aggucccgguggugugggcccagga

SEQ ID NO: 3666 - RNA, 25 nt, Homo sapiens
ggucccgguggugugggcccaggag

SEQ ID NO: 3667 - RNA, 25 nt, Homo sapiens
gucccgguggugugggcccaggagg

SEQ ID NO: 3668 - RNA, 25 nt, Homo sapiens
cccugcagccccacaaucccccucc

SEQ ID NO: 3669 - RNA, 25 nt, Homo sapiens
aggaucucagccuucugcgaagagc

SEQ ID NO: 3670 - RNA, 25 nt, Homo sapiens
ggaucucagccuucugcgaagagca

SEQ ID NO: 3671 - RNA, 25 nt, Homo sapiens
gaucucagccuucugcgaagagcag

SEQ ID NO: 3672 - RNA, 25 nt, Homo sapiens
ccuucugcgaagagcaggggucacu

SEQ ID NO: 3673 - RNA, 25 nt, Homo sapiens
ggucacuuggcagcaucagccagac

SEQ ID NO: 3674 - RNA, 25 nt, Homo sapiens
gccagacagguaugcaccccaaacu

SEQ ID NO: 3675 - RNA, 25 nt, Homo sapiens
ccagacagguaugcaccccaaacuu

SEQ ID NO: 3676 - RNA, 25 nt, Homo sapiens
aggcuucacuaggugagcaaaagag

SEQ ID NO: 3677 - RNA, 25 nt, Homo sapiens
agccccuggcuggagaggcuucacu

SEQ ID NO: 3678 - RNA, 25 nt, Homo sapiens
ccgggaccucagccccuggcuggag

SEQ ID NO: 3679 - RNA, 25 nt, Homo sapiens
caccaccgggaccucagccccuggc

SEQ ID NO: 3680 - RNA, 25 nt, Homo sapiens
cccacaccaccgggaccucagcccc

SEQ ID NO: 3681 - RNA, 25 nt, Homo sapiens
agcccccuccugggcccacaccacc

SEQ ID NO: 3682 - RNA, 25 nt, Homo sapiens
gagcccccuccugggcccacaccac

SEQ ID NO: 3683 - RNA, 25 nt, Homo sapiens
gggagcugggcaggagcccccuccu

SEQ ID NO: 3684 - RNA, 25 nt, Homo sapiens
ggggagcugggcaggagcccccucc

SEQ ID NO: 3685 - RNA, 25 nt, Homo sapiens
uuguggggcugcaggggagcugggc

SEQ ID NO: 3686 - RNA, 25 nt, Homo sapiens
gggauuguggggcugcaggggagcu

SEQ ID NO: 3687 - RNA, 25 nt, Homo sapiens
ggggauuguggggcugcaggggagc

SEQ ID NO: 3688 - RNA, 25 nt, Homo sapiens
cuggagggggauuguggggcugcag

SEQ ID NO: 3689 - RNA, 25 nt, Homo sapiens
ccuggagggggauuguggggcugca

SEQ ID NO: 3690 - RNA, 25 nt, Homo sapiens
uccuggagggggauuguggggcugc

SEQ ID NO: 3691 - RNA, 25 nt, Homo sapiens
gcugagauccuggagggggauugug

SEQ ID NO: 3692 - RNA, 25 nt, Homo sapiens
ggcugagauccuggagggggauugu

SEQ ID NO: 3693 - RNA, 25 nt, Homo sapiens
aggcugagauccuggagggggauug

SEQ ID NO: 3694 - RNA, 25 nt, Homo sapiens
ucgcagaaggcugagauccuggagg

SEQ ID NO: 3695 - RNA, 25 nt, Homo sapiens
uucgcagaaggcugagauccuggag

SEQ ID NO: 3696 - RNA, 25 nt, Homo sapiens
cuucgcagaaggcugagauccugga

SEQ ID NO: 3697 - RNA, 25 nt, Homo sapiens
ucuucgcagaaggcugagauccugg

SEQ ID NO: 3698 - RNA, 25 nt, Homo sapiens
ugcucuucgcagaaggcugagaucc

SEQ ID NO: 3699 - RNA, 25 nt, Homo sapiens
ccaagugaccccugcucuucgcaga

SEQ ID NO: 3700 - RNA, 25 nt, Homo sapiens
cccaaguuuggggugcauaccuguc

SEQ ID NO: 3701 - RNA, 25 nt, Homo sapiens
caacuccauucucuuucccgcccag

SEQ ID NO: 3702 - RNA, 25 nt, Homo sapiens
ccaguggcccgcccgcugccgcccc

SEQ ID NO: 3703 - RNA, 25 nt, Homo sapiens
cccgcugccgcccccggccaucccc

SEQ ID NO: 3704 - RNA, 25 nt, Homo sapiens
ccgcccccggccauccccuggcccc

SEQ ID NO: 3705 - RNA, 25 nt, Homo sapiens
cauccccuggcccccggcccucacc

SEQ ID NO: 3706 - RNA, 25 nt, Homo sapiens
ccccuggcccccggcccucacccgg

SEQ ID NO: 3707 - RNA, 25 nt, Homo sapiens
cccucacccggcggcgcccuccucc

SEQ ID NO: 3708 - RNA, 25 nt, Homo sapiens
ccucacccggcggcgcccuccuccu

SEQ ID NO: 3709 - RNA, 25 nt, Homo sapiens
cucacccggcggcgcccuccuccug

SEQ ID NO: 3710 - RNA, 25 nt, Homo sapiens
ucacccggcggcgcccuccuccugg

SEQ ID NO: 3711 - RNA, 25 nt, Homo sapiens
ggcggcgcccuccuccugggggccc

SEQ ID NO: 3712 - RNA, 25 nt, Homo sapiens
ugggggcccaggccccgccgcuaca

SEQ ID NO: 3713 - RNA, 25 nt, Homo sapiens
ccccgccgcuacacggugcugagcg

SEQ ID NO: 3714 - RNA, 25 nt, Homo sapiens
cccgccgcuacacggugcugagcgu

SEQ ID NO: 3715 - RNA, 25 nt, Homo sapiens
gcuacacggugcugagcgugggucc

SEQ ID NO: 3716 - RNA, 25 nt, Homo sapiens
acacggugcugagcgugggucccgg

SEQ ID NO: 3717 - RNA, 25 nt, Homo sapiens
gcgugggucccggaggccugcgcag

SEQ ID NO: 3718 - RNA, 25 nt, Homo sapiens
cgugggucccggaggccugcgcagc

SEQ ID NO: 3719 - RNA, 25 nt, Homo sapiens
gggucccggaggccugcgcagcggg

SEQ ID NO: 3720 - RNA, 25 nt, Homo sapiens
cugccccugcagccccgcguccagc

SEQ ID NO: 3721 - RNA, 25 nt, Homo sapiens
agccccgcguccagcuggaugagcg

SEQ ID NO: 3722 - RNA, 25 nt, Homo sapiens
ccgcguccagcuggaugagcgcggc

SEQ ID NO: 3723 - RNA, 25 nt, Homo sapiens
agcuggaugagcgcggccggcagcg

SEQ ID NO: 3724 - RNA, 25 nt, Homo sapiens
gcuggaugagcgcggccggcagcgc

SEQ ID NO: 3725 - RNA, 25 nt, Homo sapiens
cuggaugagcgcggccggcagcgcg

SEQ ID NO: 3726 - RNA, 25 nt, Homo sapiens
ccggcagcgcggggacuucucgcua

SEQ ID NO: 3727 - RNA, 25 nt, Homo sapiens
cuucucgcuauggcugcgcccagcc

SEQ ID NO: 3728 - RNA, 25 nt, Homo sapiens
cuauggcugcgcccagcccggcgcg

SEQ ID NO: 3729 - RNA, 25 nt, Homo sapiens
ugcgcccagcccggcgcgcggacgc

SEQ ID NO: 3730 - RNA, 25 nt, Homo sapiens
gcggacgccggcgaguaccgcgccg

SEQ ID NO: 3731 - RNA, 25 nt, Homo sapiens
cgaguaccgcgccgcggugcaccuc

SEQ ID NO: 3732 - RNA, 25 nt, Homo sapiens
gaguaccgcgccgcggugcaccuca

SEQ ID NO: 3733 - RNA, 25 nt, Homo sapiens
gcgccugggccaggccucgaguaug

SEQ ID NO: 3734 - RNA, 25 nt, Homo sapiens
cgccugggccaggccucgaguaugu

SEQ ID NO: 3735 - RNA, 25 nt, Homo sapiens
gccugggccaggccucgaguaugug

SEQ ID NO: 3736 - RNA, 25 nt, Homo sapiens
ugggccaggccucgaguaugugggg

SEQ ID NO: 3737 - RNA, 25 nt, Homo sapiens
gggccaggccucgaguauguggggc

SEQ ID NO: 3738 - RNA, 25 nt, Homo sapiens
gccucgaguauguggggcgggacga

SEQ ID NO: 3739 - RNA, 25 nt, Homo sapiens
ccucgaguauguggggcgggacgau

SEQ ID NO: 3740 - RNA, 25 nt, Homo sapiens
gcgggccacugggcgggaaagagaa

SEQ ID NO: 3741 - RNA, 25 nt, Homo sapiens
ggcggcagcgggcgggccacugggc

SEQ ID NO: 3742 - RNA, 25 nt, Homo sapiens
gggcggcagcgggcgggccacuggg

SEQ ID NO: 3743 - RNA, 25 nt, Homo sapiens
cgggggcggcagcgggcgggccacu

SEQ ID NO: 3744 - RNA, 25 nt, Homo sapiens
ccgggggcggcagcgggcgggccac

SEQ ID NO: 3745 - RNA, 25 nt, Homo sapiens
gggauggccgggggcggcagcgggc

SEQ ID NO: 3746 - RNA, 25 nt, Homo sapiens
ggggauggccgggggcggcagcggg

SEQ ID NO: 3747 - RNA, 25 nt, Homo sapiens
ccaggggauggccgggggcggcagc

SEQ ID NO: 3748 - RNA, 25 nt, Homo sapiens
gccaggggauggccgggggcggcag

SEQ ID NO: 3749 - RNA, 25 nt, Homo sapiens
ccgggggccaggggauggccggggg

SEQ ID NO: 3750 - RNA, 25 nt, Homo sapiens
gggccgggggccaggggauggccgg

SEQ ID NO: 3751 - RNA, 25 nt, Homo sapiens
agggccgggggccaggggauggccg

SEQ ID NO: 3752 - RNA, 25 nt, Homo sapiens
gagggccgggggccaggggauggcc

SEQ ID NO: 3753 - RNA, 25 nt, Homo sapiens
ugagggccgggggccaggggauggc

SEQ ID NO: 3754 - RNA, 25 nt, Homo sapiens
cgggugagggccgggggccagggga

SEQ ID NO: 3755 - RNA, 25 nt, Homo sapiens
ccgccgggugagggccgggggccag

SEQ ID NO: 3756 - RNA, 25 nt, Homo sapiens
gccgccgggugagggccgggggcca

SEQ ID NO: 3757 - RNA, 25 nt, Homo sapiens
cgccgccgggugagggccgggggcc

SEQ ID NO: 3758 - RNA, 25 nt, Homo sapiens
gagggcgccgccgggugagggccgg

SEQ ID NO: 3759 - RNA, 25 nt, Homo sapiens
ggagggcgccgccgggugagggccg

SEQ ID NO: 3760 - RNA, 25 nt, Homo sapiens
aggagggcgccgccgggugagggcc

SEQ ID NO: 3761 - RNA, 25 nt, Homo sapiens
gaggagggcgccgccgggugagggc

SEQ ID NO: 3762 - RNA, 25 nt, Homo sapiens
ccaggaggagggcgccgccggguga

SEQ ID NO: 3763 - RNA, 25 nt, Homo sapiens
cccaggaggagggcgccgccgggug

SEQ ID NO: 3764 - RNA, 25 nt, Homo sapiens
gggcccccaggaggagggcgccgcc

SEQ ID NO: 3765 - RNA, 25 nt, Homo sapiens
ugggcccccaggaggagggcgccgc

SEQ ID NO: 3766 - RNA, 25 nt, Homo sapiens
ggcggggccugggcccccaggagga

SEQ ID NO: 3767 - RNA, 25 nt, Homo sapiens
cggcggggccugggcccccaggagg

SEQ ID NO: 3768 - RNA, 25 nt, Homo sapiens
uagcggcggggccugggcccccagg

SEQ ID NO: 3769 - RNA, 25 nt, Homo sapiens
guguagcggcggggccugggccccc

SEQ ID NO: 3770 - RNA, 25 nt, Homo sapiens
ucagcaccguguagcggcggggccu

SEQ ID NO: 3771 - RNA, 25 nt, Homo sapiens
cucagcaccguguagcggcggggcc

SEQ ID NO: 3772 - RNA, 25 nt, Homo sapiens
ccacgcucagcaccguguagcggcg

SEQ ID NO: 3773 - RNA, 25 nt, Homo sapiens
cccacgcucagcaccguguagcggc

SEQ ID NO: 3774 - RNA, 25 nt, Homo sapiens
acccacgcucagcaccguguagcgg

SEQ ID NO: 3775 - RNA, 25 nt, Homo sapiens
gggacccacgcucagcaccguguag

SEQ ID NO: 3776 - RNA, 25 nt, Homo sapiens
gcagccucccgcugcgcaggccucc

SEQ ID NO: 3777 - RNA, 25 nt, Homo sapiens
ggcagccucccgcugcgcaggccuc

SEQ ID NO: 3778 - RNA, 25 nt, Homo sapiens
cugcaggggcagccucccgcugcgc

SEQ ID NO: 3779 - RNA, 25 nt, Homo sapiens
cauccagcuggacgcggggcugcag

SEQ ID NO: 3780 - RNA, 25 nt, Homo sapiens
ucauccagcuggacgcggggcugca

SEQ ID NO: 3781 - RNA, 25 nt, Homo sapiens
cucauccagcuggacgcggggcugc

SEQ ID NO: 3782 - RNA, 25 nt, Homo sapiens
ggccgcgcucauccagcuggacgcg

SEQ ID NO: 3783 - RNA, 25 nt, Homo sapiens
cggccgcgcucauccagcuggacgc

SEQ ID NO: 3784 - RNA, 25 nt, Homo sapiens
ccggccgcgcucauccagcuggacg

SEQ ID NO: 3785 - RNA, 25 nt, Homo sapiens
gcgcugccggccgcgcucauccagc

SEQ ID NO: 3786 - RNA, 25 nt, Homo sapiens
ccauagcgagaaguccccgcgcugc

SEQ ID NO: 3787 - RNA, 25 nt, Homo sapiens
cucgccggcguccgcgcgccgggcu

SEQ ID NO: 3788 - RNA, 25 nt, Homo sapiens
acucgccggcguccgcgcgccgggc

SEQ ID NO: 3789 - RNA, 25 nt, Homo sapiens
cgguacucgccggcguccgcgcgcc

SEQ ID NO: 3790 - RNA, 25 nt, Homo sapiens
gcgguacucgccggcguccgcgcgc

SEQ ID NO: 3791 - RNA, 25 nt, Homo sapiens
aggugcaccgcggcgcgguacucgc

SEQ ID NO: 3792 - RNA, 25 nt, Homo sapiens
cgggucccugaggugcaccgcggcg

SEQ ID NO: 3793 - RNA, 25 nt, Homo sapiens
ucccgcgggucccugaggugcaccg

SEQ ID NO: 3794 - RNA, 25 nt, Homo sapiens
cgccguccucucccgcgggucccug

SEQ ID NO: 3795 - RNA, 25 nt, Homo sapiens
gucugccuccgccguccucucccgc

SEQ ID NO: 3796 - RNA, 25 nt, Homo sapiens
cuugcacagugacugccagcccccc

SEQ ID NO: 3797 - RNA, 25 nt, Homo sapiens
cccaggaucucucagagccuccgac

SEQ ID NO: 3798 - RNA, 25 nt, Homo sapiens
ccaggaucucucagagccuccgacu

SEQ ID NO: 3799 - RNA, 25 nt, Homo sapiens
cccugaccgcccagccucugugcau

SEQ ID NO: 3800 - RNA, 25 nt, Homo sapiens
ccgcccagccucugugcauugguuc

SEQ ID NO: 3801 - RNA, 25 nt, Homo sapiens
agccucugugcauugguuccggaac

SEQ ID NO: 3802 - RNA, 25 nt, Homo sapiens
gccucugugcauugguuccggaacc

SEQ ID NO: 3803 - RNA, 25 nt, Homo sapiens
ccucugugcauugguuccggaaccg

SEQ ID NO: 3804 - RNA, 25 nt, Homo sapiens
gugcauugguuccggaaccggggcc

SEQ ID NO: 3805 - RNA, 25 nt, Homo sapiens
ugcauugguuccggaaccggggcca

SEQ ID NO: 3806 - RNA, 25 nt, Homo sapiens
ccggggccagggccgagucccuguc

SEQ ID NO: 3807 - RNA, 25 nt, Homo sapiens
cggggccagggccgagucccugucc

SEQ ID NO: 3808 - RNA, 25 nt, Homo sapiens
cgggaguccccccaucaccacuuag

SEQ ID NO: 3809 - RNA, 25 nt, Homo sapiens
cucuuccugccccaagucagcccca

SEQ ID NO: 3810 - RNA, 25 nt, Homo sapiens
ugccccaagucagccccauggacuc

SEQ ID NO: 3811 - RNA, 25 nt, Homo sapiens
gccccaagucagccccauggacucu

SEQ ID NO: 3812 - RNA, 25 nt, Homo sapiens
agucagccccauggacucugggccc

SEQ ID NO: 3813 - RNA, 25 nt, Homo sapiens
gucagccccauggacucugggcccu

SEQ ID NO: 3814 - RNA, 25 nt, Homo sapiens
ucagccccauggacucugggcccug

SEQ ID NO: 3815 - RNA, 25 nt, Homo sapiens
ggggcugcauccucaccuacagaga

SEQ ID NO: 3816 - RNA, 25 nt, Homo sapiens
uccaucauguauaaccucacuguuc

SEQ ID NO: 3817 - RNA, 25 nt, Homo sapiens
ccaucauguauaaccucacuguucu

SEQ ID NO: 3818 - RNA, 25 nt, Homo sapiens
cuggggggcuggcagucacugugca

SEQ ID NO: 3819 - RNA, 25 nt, Homo sapiens
gaggcucugagagauccuggggggc

SEQ ID NO: 3820 - RNA, 25 nt, Homo sapiens
gucggaggcucugagagauccuggg

SEQ ID NO: 3821 - RNA, 25 nt, Homo sapiens
agucggaggcucugagagauccugg

SEQ ID NO: 3822 - RNA, 25 nt, Homo sapiens
cagucggaggcucugagagauccug

SEQ ID NO: 3823 - RNA, 25 nt, Homo sapiens
ccagucggaggcucugagagauccu

SEQ ID NO: 3824 - RNA, 25 nt, Homo sapiens
cccagucggaggcucugagagaucc

SEQ ID NO: 3825 - RNA, 25 nt, Homo sapiens
gagcaguucaaaaugacccagucgg

SEQ ID NO: 3826 - RNA, 25 nt, Homo sapiens
aaggagcaguucaaaaugacccagu

SEQ ID NO: 3827 - RNA, 25 nt, Homo sapiens
gaggcugggcggucagggcggcuga

SEQ ID NO: 3828 - RNA, 25 nt, Homo sapiens
augcacagaggcugggcggucaggg

SEQ ID NO: 3829 - RNA, 25 nt, Homo sapiens
ccaaugcacagaggcugggcgguca

SEQ ID NO: 3830 - RNA, 25 nt, Homo sapiens
accaaugcacagaggcugggcgguc

SEQ ID NO: 3831 - RNA, 25 nt, Homo sapiens
ccggaaccaaugcacagaggcuggg

SEQ ID NO: 3832 - RNA, 25 nt, Homo sapiens
guuccggaaccaaugcacagaggcu

SEQ ID NO: 3833 - RNA, 25 nt, Homo sapiens
gguuccggaaccaaugcacagaggc

SEQ ID NO: 3834 - RNA, 25 nt, Homo sapiens
ccccgguuccggaaccaaugcacag

SEQ ID NO: 3835 - RNA, 25 nt, Homo sapiens
agggacucggcccuggccccgguuc

SEQ ID NO: 3836 - RNA, 25 nt, Homo sapiens
ccggacagggacucggcccuggccc

SEQ ID NO: 3837 - RNA, 25 nt, Homo sapiens
ggacucccggacagggacucggccc

SEQ ID NO: 3838 - RNA, 25 nt, Homo sapiens
auggggggacucccggacagggacu

SEQ ID NO: 3839 - RNA, 25 nt, Homo sapiens
guggugauggggggacucccggaca

SEQ ID NO: 3840 - RNA, 25 nt, Homo sapiens
aguggugauggggggacucccggac

SEQ ID NO: 3841 - RNA, 25 nt, Homo sapiens
cgcuaaguggugauggggggacucc

SEQ ID NO: 3842 - RNA, 25 nt, Homo sapiens
aagcuuuccgcuaaguggugauggg

SEQ ID NO: 3843 - RNA, 25 nt, Homo sapiens
gaagcuuuccgcuaaguggugaugg

SEQ ID NO: 3844 - RNA, 25 nt, Homo sapiens
ggaagcuuuccgcuaaguggugaug

SEQ ID NO: 3845 - RNA, 25 nt, Homo sapiens
aggaagcuuuccgcuaaguggugau

SEQ ID NO: 3846 - RNA, 25 nt, Homo sapiens
gaggaagcuuuccgcuaagugguga

SEQ ID NO: 3847 - RNA, 25 nt, Homo sapiens
caggaagaggaagcuuuccgcuaag

SEQ ID NO: 3848 - RNA, 25 nt, Homo sapiens
cauggggcugacuuggggcaggaag

SEQ ID NO: 3849 - RNA, 25 nt, Homo sapiens
agaguccauggggcugacuuggggc

SEQ ID NO: 3850 - RNA, 25 nt, Homo sapiens
gcccagaguccauggggcugacuug

SEQ ID NO: 3851 - RNA, 25 nt, Homo sapiens
ggcccagaguccauggggcugacuu

SEQ ID NO: 3852 - RNA, 25 nt, Homo sapiens
gggcccagaguccauggggcugacu

SEQ ID NO: 3853 - RNA, 25 nt, Homo sapiens
gcagccccagggcccagaguccaug

SEQ ID NO: 3854 - RNA, 25 nt, Homo sapiens
ugcagccccagggcccagaguccau

SEQ ID NO: 3855 - RNA, 25 nt, Homo sapiens
augcagccccagggcccagagucca

SEQ ID NO: 3856 - RNA, 25 nt, Homo sapiens
cucuguaggugaggaugcagcccca

SEQ ID NO: 3857 - RNA, 25 nt, Homo sapiens
ucucuguaggugaggaugcagcccc

SEQ ID NO: 3858 - RNA, 25 nt, Homo sapiens
gacguugaagccaucucuguaggug

SEQ ID NO: 3859 - RNA, 25 nt, Homo sapiens
auggagacguugaagccaucucugu

SEQ ID NO: 3860 - RNA, 25 nt, Homo sapiens
cccagaacagugagguuauacauga

SEQ ID NO: 3861 - RNA, 25 nt, Homo sapiens
agugggggaguuacccagaacagug

SEQ ID NO: 3862 - RNA, 25 nt, Homo sapiens
uuggguuuucuuuucucuucagguc

SEQ ID NO: 3863 - RNA, 25 nt, Homo sapiens
ccccaacucccuugacaguguacgc

SEQ ID NO: 3864 - RNA, 25 nt, Homo sapiens
cucccuugacaguguacgcuggagc

SEQ ID NO: 3865 - RNA, 25 nt, Homo sapiens
gacaguguacgcuggagcagguucc

SEQ ID NO: 3866 - RNA, 25 nt, Homo sapiens
acaguguacgcuggagcagguucca

SEQ ID NO: 3867 - RNA, 25 nt, Homo sapiens
guguacgcuggagcagguuccaggg

SEQ ID NO: 3868 - RNA, 25 nt, Homo sapiens
uguacgcuggagcagguuccagggu

SEQ ID NO: 3869 - RNA, 25 nt, Homo sapiens
guacgcuggagcagguuccagggug

SEQ ID NO: 3870 - RNA, 25 nt, Homo sapiens
uggggcugcccugccgccugccugc

SEQ ID NO: 3871 - RNA, 25 nt, Homo sapiens
cugcccugccgccugccugcuggug

SEQ ID NO: 3872 - RNA, 25 nt, Homo sapiens
ugcccugccgccugccugcuggugu

SEQ ID NO: 3873 - RNA, 25 nt, Homo sapiens
gcccugccgccugccugcuggugug

SEQ ID NO: 3874 - RNA, 25 nt, Homo sapiens
ccgccugccugcugguguggggacc

SEQ ID NO: 3875 - RNA, 25 nt, Homo sapiens
gacccggucuuuccucacugccaag

SEQ ID NO: 3876 - RNA, 25 nt, Homo sapiens
uccucacugccaaguggacuccucc

SEQ ID NO: 3877 - RNA, 25 nt, Homo sapiens
ccucacugccaaguggacuccuccu

SEQ ID NO: 3878 - RNA, 25 nt, Homo sapiens
cucacugccaaguggacuccuccug

SEQ ID NO: 3879 - RNA, 25 nt, Homo sapiens
ucacugccaaguggacuccuccugg

SEQ ID NO: 3880 - RNA, 25 nt, Homo sapiens
cugccaaguggacuccuccuggggg

SEQ ID NO: 3881 - RNA, 25 nt, Homo sapiens
ccuccugggggaggcccugaccucc

SEQ ID NO: 3882 - RNA, 25 nt, Homo sapiens
ggggaggcccugaccuccuggugac

SEQ ID NO: 3883 - RNA, 25 nt, Homo sapiens
cugaccuccuggugacuggagacaa

SEQ ID NO: 3884 - RNA, 25 nt, Homo sapiens
aauggcgacuuuacccuucgacuag

SEQ ID NO: 3885 - RNA, 25 nt, Homo sapiens
acccuucgacuagaggaugugagcc

SEQ ID NO: 3886 - RNA, 25 nt, Homo sapiens
cgacuagaggaugugagccaggccc

SEQ ID NO: 3887 - RNA, 25 nt, Homo sapiens
uagaggaugugagccaggcccaggc

SEQ ID NO: 3888 - RNA, 25 nt, Homo sapiens
agaggaugugagccaggcccaggcu

SEQ ID NO: 3889 - RNA, 25 nt, Homo sapiens
accuacaccugccauauccaucugc

SEQ ID NO: 3890 - RNA, 25 nt, Homo sapiens
cagcagcucaaugccacugucacau

SEQ ID NO: 3891 - RNA, 25 nt, Homo sapiens
ccacugucacauuggcaaucaucac

SEQ ID NO: 3892 - RNA, 25 nt, Homo sapiens
uuggcaaucaucacaggucagccuc

SEQ ID NO: 3893 - RNA, 25 nt, Homo sapiens
gcaaucaucacaggucagccucagg

SEQ ID NO: 3894 - RNA, 25 nt, Homo sapiens
caaucaucacaggucagccucaggu

SEQ ID NO: 3895 - RNA, 25 nt, Homo sapiens
aucacaggucagccucaggugggaa

SEQ ID NO: 3896 - RNA, 25 nt, Homo sapiens
cagcguacacugucaagggaguugg

SEQ ID NO: 3897 - RNA, 25 nt, Homo sapiens
ccagcguacacugucaagggaguug

SEQ ID NO: 3898 - RNA, 25 nt, Homo sapiens
uccagcguacacugucaagggaguu

SEQ ID NO: 3899 - RNA, 25 nt, Homo sapiens
cuccagcguacacugucaagggagu

SEQ ID NO: 3900 - RNA, 25 nt, Homo sapiens
aaccugcuccagcguacacugucaa

SEQ ID NO: 3901 - RNA, 25 nt, Homo sapiens
gaaccugcuccagcguacacuguca

SEQ ID NO: 3902 - RNA, 25 nt, Homo sapiens
ggcaggcggcagggcagccccaccc

SEQ ID NO: 3903 - RNA, 25 nt, Homo sapiens
uccccacaccagcaggcaggcggca

SEQ ID NO: 3904 - RNA, 25 nt, Homo sapiens
guccccacaccagcaggcaggcggc

SEQ ID NO: 3905 - RNA, 25 nt, Homo sapiens
ccggguccccacaccagcaggcagg

SEQ ID NO: 3906 - RNA, 25 nt, Homo sapiens
agaccggguccccacaccagcaggc

SEQ ID NO: 3907 - RNA, 25 nt, Homo sapiens
ggaaagaccggguccccacaccagc

SEQ ID NO: 3908 - RNA, 25 nt, Homo sapiens
guccacuuggcagugaggaaagacc

SEQ ID NO: 3909 - RNA, 25 nt, Homo sapiens
aguccacuuggcagugaggaaagac

SEQ ID NO: 3910 - RNA, 25 nt, Homo sapiens
cccaggaggaguccacuuggcagug

SEQ ID NO: 3911 - RNA, 25 nt, Homo sapiens
gggccucccccaggaggaguccacu

SEQ ID NO: 3912 - RNA, 25 nt, Homo sapiens
ccaggaggucagggccucccccagg

SEQ ID NO: 3913 - RNA, 25 nt, Homo sapiens
ucaccaggaggucagggccuccccc

SEQ ID NO: 3914 - RNA, 25 nt, Homo sapiens
auugucuccagucaccaggagguca

SEQ ID NO: 3915 - RNA, 25 nt, Homo sapiens
cauugucuccagucaccaggagguc

SEQ ID NO: 3916 - RNA, 25 nt, Homo sapiens
gucgccauugucuccagucaccagg

SEQ ID NO: 3917 - RNA, 25 nt, Homo sapiens
aaagucgccauugucuccagucacc

SEQ ID NO: 3918 - RNA, 25 nt, Homo sapiens
gccuggcucacauccucuagucgaa

SEQ ID NO: 3919 - RNA, 25 nt, Homo sapiens
ggccuggcucacauccucuagucga

SEQ ID NO: 3920 - RNA, 25 nt, Homo sapiens
gcagguguaggucccagccugggcc

SEQ ID NO: 3921 - RNA, 25 nt, Homo sapiens
auauggcagguguaggucccagccu

SEQ ID NO: 3922 - RNA, 25 nt, Homo sapiens
gauauggcagguguaggucccagcc

SEQ ID NO: 3923 - RNA, 25 nt, Homo sapiens
uccugcagauggauauggcaggugu

SEQ ID NO: 3924 - RNA, 25 nt, Homo sapiens
ugcuguuccugcagauggauauggc

SEQ ID NO: 3925 - RNA, 25 nt, Homo sapiens
gagcugcuguuccugcagauggaua

SEQ ID NO: 3926 - RNA, 25 nt, Homo sapiens
ggcauugagcugcuguuccugcaga

SEQ ID NO: 3927 - RNA, 25 nt, Homo sapiens
ccugugaugauugccaaugugacag

SEQ ID NO: 3928 - RNA, 25 nt, Homo sapiens
ucuuuucagugacucccaaauccuu

SEQ ID NO: 3929 - RNA, 25 nt, Homo sapiens
cuuuucagugacucccaaauccuuu

SEQ ID NO: 3930 - RNA, 25 nt, Homo sapiens
ugacucccaaauccuuugggucacc

SEQ ID NO: 3931 - RNA, 25 nt, Homo sapiens
aaauccuuugggucaccuggauccc

SEQ ID NO: 3932 - RNA, 25 nt, Homo sapiens
aauccuuugggucaccuggaucccu

SEQ ID NO: 3933 - RNA, 25 nt, Homo sapiens
auccuuugggucaccuggaucccug

SEQ ID NO: 3934 - RNA, 25 nt, Homo sapiens
ggaucccuggggaagcugcuuugug

SEQ ID NO: 3935 - RNA, 25 nt, Homo sapiens
ugcuuugugaggugacuccaguauc

SEQ ID NO: 3936 - RNA, 25 nt, Homo sapiens
aguaucuggacaagaacgcuuugug

SEQ ID NO: 3937 - RNA, 25 nt, Homo sapiens
caagaacgcuuuguguggagcucuc

SEQ ID NO: 3938 - RNA, 25 nt, Homo sapiens
gagcucucuggacaccccaucccag

SEQ ID NO: 3939 - RNA, 25 nt, Homo sapiens
acaccccaucccagaggaguuucuc

SEQ ID NO: 3940 - RNA, 25 nt, Homo sapiens
aucccagaggaguuucucaggaccu

SEQ ID NO: 3941 - RNA, 25 nt, Homo sapiens
cagaggaguuucucaggaccuuggc

SEQ ID NO: 3942 - RNA, 25 nt, Homo sapiens
aggaguuucucaggaccuuggcugg

SEQ ID NO: 3943 - RNA, 25 nt, Homo sapiens
uucucaggaccuuggcuggaggcac

SEQ ID NO: 3944 - RNA, 25 nt, Homo sapiens
ucaggaccuuggcuggaggcacagg

SEQ ID NO: 3945 - RNA, 25 nt, Homo sapiens
ggaggcccagcuccuuucccagccu

SEQ ID NO: 3946 - RNA, 25 nt, Homo sapiens
cagccuuggcaaugccagcuguacc

SEQ ID NO: 3947 - RNA, 25 nt, Homo sapiens
agccuuggcaaugccagcuguacca

SEQ ID NO: 3948 - RNA, 25 nt, Homo sapiens
gccuuggcaaugccagcuguaccag

SEQ ID NO: 3949 - RNA, 25 nt, Homo sapiens
ccuuggcaaugccagcuguaccagg

SEQ ID NO: 3950 - RNA, 25 nt, Homo sapiens
gcaaugccagcuguaccagggggag

SEQ ID NO: 3951 - RNA, 25 nt, Homo sapiens
agcuguaccagggggagaggcuucu

SEQ ID NO: 3952 - RNA, 25 nt, Homo sapiens
uguacuucacagagcugucuagccc

SEQ ID NO: 3953 - RNA, 25 nt, Homo sapiens
cacagagcugucuagcccagguccg

SEQ ID NO: 3954 - RNA, 25 nt, Homo sapiens
cccagguccgaggccccagaaugcc

SEQ ID NO: 3955 - RNA, 25 nt, Homo sapiens
uuugggagucacugaaaagaguaga

SEQ ID NO: 3956 - RNA, 25 nt, Homo sapiens
gggauccaggugacccaaaggauuu

SEQ ID NO: 3957 - RNA, 25 nt, Homo sapiens
agggauccaggugacccaaaggauu

SEQ ID NO: 3958 - RNA, 25 nt, Homo sapiens
uuccccagggauccaggugacccaa

SEQ ID NO: 3959 - RNA, 25 nt, Homo sapiens
cacaaagcagcuuccccagggaucc

SEQ ID NO: 3960 - RNA, 25 nt, Homo sapiens
gucaccucacaaagcagcuucccca

SEQ ID NO: 3961 - RNA, 25 nt, Homo sapiens
agucaccucacaaagcagcuucccc

SEQ ID NO: 3962 - RNA, 25 nt, Homo sapiens
acacaaagcguucuuguccagauac

SEQ ID NO: 3963 - RNA, 25 nt, Homo sapiens
gguccugagaaacuccucugggaug

SEQ ID NO: 3964 - RNA, 25 nt, Homo sapiens
agguccugagaaacuccucugggau

SEQ ID NO: 3965 - RNA, 25 nt, Homo sapiens
aagguccugagaaacuccucuggga

SEQ ID NO: 3966 - RNA, 25 nt, Homo sapiens
agccaagguccugagaaacuccucu

SEQ ID NO: 3967 - RNA, 25 nt, Homo sapiens
cagccaagguccugagaaacuccuc

SEQ ID NO: 3968 - RNA, 25 nt, Homo sapiens
gcugggccuccugugccuccagcca

SEQ ID NO: 3969 - RNA, 25 nt, Homo sapiens
cauugccaaggcugggaaaggagcu

SEQ ID NO: 3970 - RNA, 25 nt, Homo sapiens
gcauugccaaggcugggaaaggagc

SEQ ID NO: 3971 - RNA, 25 nt, Homo sapiens
cagcuggcauugccaaggcugggaa

SEQ ID NO: 3972 - RNA, 25 nt, Homo sapiens
ugguacagcuggcauugccaaggcu

SEQ ID NO: 3973 - RNA, 25 nt, Homo sapiens
cugguacagcuggcauugccaaggc

SEQ ID NO: 3974 - RNA, 25 nt, Homo sapiens
cccccugguacagcuggcauugcca

SEQ ID NO: 3975 - RNA, 25 nt, Homo sapiens
aagaagccucucccccugguacagc

SEQ ID NO: 3976 - RNA, 25 nt, Homo sapiens
ugcugcuccaagaagccucuccccc

SEQ ID NO: 3977 - RNA, 25 nt, Homo sapiens
ccuggcauucuggggccucggaccu

SEQ ID NO: 3978 - RNA, 25 nt, Homo sapiens
uccuggcauucuggggccucggacc

SEQ ID NO: 3979 - RNA, 25 nt, Homo sapiens
cuuucuccauaggugcccaacgcuc

SEQ ID NO: 3980 - RNA, 25 nt, Homo sapiens
uuucuccauaggugcccaacgcucu

SEQ ID NO: 3981 - RNA, 25 nt, Homo sapiens
gugcccaacgcucugggagagcccc

SEQ ID NO: 3982 - RNA, 25 nt, Homo sapiens
ggagagccccaggugcccucccagc

SEQ ID NO: 3983 - RNA, 25 nt, Homo sapiens
gccaccuccugcuguuucucauccu

SEQ ID NO: 3984 - RNA, 25 nt, Homo sapiens
cuugguguccuuucucugcuccuuu

SEQ ID NO: 3985 - RNA, 25 nt, Homo sapiens
uccuuucucugcuccuuuuggugac

SEQ ID NO: 3986 - RNA, 25 nt, Homo sapiens
ugcuccuuuuggugacuggagccuu

SEQ ID NO: 3987 - RNA, 25 nt, Homo sapiens
gacuggagccuuuggcuuucaccuu

SEQ ID NO: 3988 - RNA, 25 nt, Homo sapiens
uuuggcuuucaccuuuggagaagac

SEQ ID NO: 3989 - RNA, 25 nt, Homo sapiens
caccuuuggagaagacaggugagcc

SEQ ID NO: 3990 - RNA, 25 nt, Homo sapiens
accuuuggagaagacaggugagcca

SEQ ID NO: 3991 - RNA, 25 nt, Homo sapiens
ggagaagacaggugagccagggaca

SEQ ID NO: 3992 - RNA, 25 nt, Homo sapiens
cguugggcaccuauggagaaaguac

SEQ ID NO: 3993 - RNA, 25 nt, Homo sapiens
gcucucccagagcguugggcaccua

SEQ ID NO: 3994 - RNA, 25 nt, Homo sapiens
gcaccuggggcucucccagagcguu

SEQ ID NO: 3995 - RNA, 25 nt, Homo sapiens
ggcaccuggggcucucccagagcgu

SEQ ID NO: 3996 - RNA, 25 nt, Homo sapiens
agguggccugcugggagggcaccug

SEQ ID NO: 3997 - RNA, 25 nt, Homo sapiens
gagguggccugcugggagggcaccu

SEQ ID NO: 3998 - RNA, 25 nt, Homo sapiens
ggagguggccugcugggagggcacc

SEQ ID NO: 3999 - RNA, 25 nt, Homo sapiens
aacagcaggagguggccugcuggga

SEQ ID NO: 4000 - RNA, 25 nt, Homo sapiens
aaacagcaggagguggccugcuggg

SEQ ID NO: 4001 - RNA, 25 nt, Homo sapiens
gagaaacagcaggagguggccugcu

SEQ ID NO: 4002 - RNA, 25 nt, Homo sapiens
ugagaaacagcaggagguggccugc

SEQ ID NO: 4003 - RNA, 25 nt, Homo sapiens
accaaggaugagaaacagcaggagg

SEQ ID NO: 4004 - RNA, 25 nt, Homo sapiens
gacaccaaggaugagaaacagcagg

SEQ ID NO: 4005 - RNA, 25 nt, Homo sapiens
aaggacaccaaggaugagaaacagc

SEQ ID NO: 4006 - RNA, 25 nt, Homo sapiens
caaaaggagcagagaaaggacacca

SEQ ID NO: 4007 - RNA, 25 nt, Homo sapiens
uccagucaccaaaaggagcagagaa

SEQ ID NO: 4008 - RNA, 25 nt, Homo sapiens
aaagccaaaggcuccagucaccaaa

SEQ ID NO: 4009 - RNA, 25 nt, Homo sapiens
ugucuucuccaaaggugaaagccaa

SEQ ID NO: 4010 - RNA, 25 nt, Homo sapiens
ucccuggcucaccugucuucuccaa

SEQ ID NO: 4011 - RNA, 25 nt, Homo sapiens
ucucucucuccaucucuucucacag

SEQ ID NO: 4012 - RNA, 25 nt, Homo sapiens
caagacgauuuucugccuuagagca

SEQ ID NO: 4013 - RNA, 25 nt, Homo sapiens
aagacgauuuucugccuuagagcaa

SEQ ID NO: 4014 - RNA, 25 nt, Homo sapiens
uuagagcaagggauucacccuccgc

SEQ ID NO: 4015 - RNA, 25 nt, Homo sapiens
ccuccgcaggcucagagcaagauag

SEQ ID NO: 4016 - RNA, 25 nt, Homo sapiens
caggcucagagcaagauagaggagc

SEQ ID NO: 4017 - RNA, 25 nt, Homo sapiens
agcccgagccggagcagcucugacc

SEQ ID NO: 4018 - RNA, 25 nt, Homo sapiens
ccggagcagcucugaccuggagcug

SEQ ID NO: 4019 - RNA, 25 nt, Homo sapiens
ucccugucagcagcaagccugaguc

SEQ ID NO: 4020 - RNA, 25 nt, Homo sapiens
ucuuggucgccacugugagaagaga

SEQ ID NO: 4021 - RNA, 25 nt, Homo sapiens
cuugcucuaaggcagaaaaucgucu

SEQ ID NO: 4022 - RNA, 25 nt, Homo sapiens
ugcggagggugaaucccuugcucua

SEQ ID NO: 4023 - RNA, 25 nt, Homo sapiens
cucuaucuugcucugagccugcgga

SEQ ID NO: 4024 - RNA, 25 nt, Homo sapiens
ccucuaucuugcucugagccugcgg

SEQ ID NO: 4025 - RNA, 25 nt, Homo sapiens
gcuccucuaucuugcucugagccug

SEQ ID NO: 4026 - RNA, 25 nt, Homo sapiens
gagaucugcuggcugccucagcucc

SEQ ID NO: 4027 - RNA, 25 nt, Homo sapiens
uuuggacugggcugcugagaucugc

SEQ ID NO: 4028 - RNA, 25 nt, Homo sapiens
ugcugacagggaguuuauuuggacu

SEQ ID NO: 4029 - RNA, 25 nt, Homo sapiens
cugcugacagggaguuuauuuggac

SEQ ID NO: 4030 - RNA, 25 nt, Homo sapiens
gcuugcugcugacagggaguuuauu

SEQ ID NO: 4031 - RNA, 25 nt, Homo sapiens
gccagacucaggcuugcugcugaca

SEQ ID NO: 4032 - RNA, 25 nt, Homo sapiens
agccagacucaggcuugcugcugac

SEQ ID NO: 4033 - RNA, 25 nt, Homo sapiens
uauaauuauaauauaauagaaccac

SEQ ID NO: 4034 - RNA, 25 nt, Homo sapiens
auaauuauaauauaauagaaccaca

SEQ ID NO: 4035 - RNA, 25 nt, Homo sapiens
uuauaauauaauagaaccacaggga

SEQ ID NO: 4036 - RNA, 25 nt, Homo sapiens
uauaauauaauagaaccacagggaa

SEQ ID NO: 4037 - RNA, 25 nt, Homo sapiens
auaauauaauagaaccacagggaag

SEQ ID NO: 4038 - RNA, 25 nt, Homo sapiens
uaauauaauagaaccacagggaagg

SEQ ID NO: 4039 - RNA, 25 nt, Homo sapiens
gggggaucccuugucccagccacuc

SEQ ID NO: 4040 - RNA, 25 nt, Homo sapiens
uugucccagccacucaggugccugc

SEQ ID NO: 4041 - RNA, 25 nt, Homo sapiens
gccacucaggugccugcuggccgcc

SEQ ID NO: 4042 - RNA, 25 nt, Homo sapiens
aggugccugcuggccgccuggaugc

SEQ ID NO: 4043 - RNA, 25 nt, Homo sapiens
ugccugcuggccgccuggaugcugg

SEQ ID NO: 4044 - RNA, 25 nt, Homo sapiens
gccuggaugcugguggcccugcccc

SEQ ID NO: 4045 - RNA, 25 nt, Homo sapiens
gaugcugguggcccugccccaggag

SEQ ID NO: 4046 - RNA, 25 nt, Homo sapiens
augcugguggcccugccccaggagu

SEQ ID NO: 4047 - RNA, 25 nt, Homo sapiens
ugcugguggcccugccccaggagug

SEQ ID NO: 4048 - RNA, 25 nt, Homo sapiens
gcugguggcccugccccaggagugg

SEQ ID NO: 4049 - RNA, 25 nt, Homo sapiens
gccccaggagugggggugcagugug

SEQ ID NO: 4050 - RNA, 25 nt, Homo sapiens
agugggggugcaguguguggaugug

SEQ ID NO: 4051 - RNA, 25 nt, Homo sapiens
gggugcaguguguggaugugaggag

SEQ ID NO: 4052 - RNA, 25 nt, Homo sapiens
caguguguggaugugaggaguggau

SEQ ID NO: 4053 - RNA, 25 nt, Homo sapiens
guggaugugaggaguggauaggcca

SEQ ID NO: 4054 - RNA, 25 nt, Homo sapiens
gaugugaggaguggauaggccacgg

SEQ ID NO: 4055 - RNA, 25 nt, Homo sapiens
augugaggaguggauaggccacggc

SEQ ID NO: 4056 - RNA, 25 nt, Homo sapiens
ugugaggaguggauaggccacggcg

SEQ ID NO: 4057 - RNA, 25 nt, Homo sapiens
gugaggaguggauaggccacggcgg

SEQ ID NO: 4058 - RNA, 25 nt, Homo sapiens
guggauaggccacggcggggguacu

SEQ ID NO: 4059 - RNA, 25 nt, Homo sapiens
aggccacggcggggguacuaggccc

SEQ ID NO: 4060 - RNA, 25 nt, Homo sapiens
ggccacggcggggguacuaggcccc

SEQ ID NO: 4061 - RNA, 25 nt, Homo sapiens
gccacggcggggguacuaggccccg

SEQ ID NO: 4062 - RNA, 25 nt, Homo sapiens
ccacggcggggguacuaggccccgg

SEQ ID NO: 4063 - RNA, 25 nt, Homo sapiens
ggggaacgccuguaccuucccaccc

SEQ ID NO: 4064 - RNA, 25 nt, Homo sapiens
cgccuguaccuucccacccaggccc

SEQ ID NO: 4065 - RNA, 25 nt, Homo sapiens
cuguaccuucccacccaggcccugg

SEQ ID NO: 4066 - RNA, 25 nt, Homo sapiens
uguaccuucccacccaggcccuggu

SEQ ID NO: 4067 - RNA, 25 nt, Homo sapiens
ucccacccaggcccuggugggagcc

SEQ ID NO: 4068 - RNA, 25 nt, Homo sapiens
ccggccaaccccuuuaaauaauuuc

SEQ ID NO: 4069 - RNA, 25 nt, Homo sapiens
caaccccuuuaaauaauuucaggaa

SEQ ID NO: 4070 - RNA, 25 nt, Homo sapiens
aaccccuuuaaauaauuucaggaau

SEQ ID NO: 4071 - RNA, 25 nt, Homo sapiens
uaaauaauuucaggaauggguucca

SEQ ID NO: 4072 - RNA, 25 nt, Homo sapiens
ggaauggguuccaaggagagcuccc

SEQ ID NO: 4073 - RNA, 25 nt, Homo sapiens
gaauggguuccaaggagagcuccca

SEQ ID NO: 4074 - RNA, 25 nt, Homo sapiens
uggguuccaaggagagcucccaggg

SEQ ID NO: 4075 - RNA, 25 nt, Homo sapiens
ggguuccaaggagagcucccagggu

SEQ ID NO: 4076 - RNA, 25 nt, Homo sapiens
aaggagagcucccagggugggcaca

SEQ ID NO: 4077 - RNA, 25 nt, Homo sapiens
aggagagcucccagggugggcacau

SEQ ID NO: 4078 - RNA, 25 nt, Homo sapiens
ggagagcucccagggugggcacaug

SEQ ID NO: 4079 - RNA, 25 nt, Homo sapiens
gagagcucccagggugggcacaugg

SEQ ID NO: 4080 - RNA, 25 nt, Homo sapiens
agagcucccagggugggcacauggg

SEQ ID NO: 4081 - RNA, 25 nt, Homo sapiens
ccagggugggcacauggggggcccu

SEQ ID NO: 4082 - RNA, 25 nt, Homo sapiens
cugcacuucugcccucccaacaccc

SEQ ID NO: 4083 - RNA, 25 nt, Homo sapiens
cacuucugcccucccaacacccagg

SEQ ID NO: 4084 - RNA, 25 nt, Homo sapiens
cucccaacacccagguggccacagc

SEQ ID NO: 4085 - RNA, 25 nt, Homo sapiens
ucccaacacccagguggccacagcu

SEQ ID NO: 4086 - RNA, 25 nt, Homo sapiens
caacacccagguggccacagcuggg

SEQ ID NO: 4087 - RNA, 25 nt, Homo sapiens
aacacccagguggccacagcuggga

SEQ ID NO: 4088 - RNA, 25 nt, Homo sapiens
acacccagguggccacagcugggag

SEQ ID NO: 4089 - RNA, 25 nt, Homo sapiens
aaccccagcccugcccuccugaccu

SEQ ID NO: 4090 - RNA, 25 nt, Homo sapiens
accccagcccugcccuccugaccuu

SEQ ID NO: 4091 - RNA, 25 nt, Homo sapiens
ccugcccuccugaccuugggaccgu

SEQ ID NO: 4092 - RNA, 25 nt, Homo sapiens
gaccguaggaugucccucucccgag

SEQ ID NO: 4093 - RNA, 25 nt, Homo sapiens
ggaugucccucucccgaguggugug

SEQ ID NO: 4094 - RNA, 25 nt, Homo sapiens
gaugucccucucccgagugguguga

SEQ ID NO: 4095 - RNA, 25 nt, Homo sapiens
augucccucucccgaguggugugag

SEQ ID NO: 4096 - RNA, 25 nt, Homo sapiens
cccucucccgaguggugugaggggc

SEQ ID NO: 4097 - RNA, 25 nt, Homo sapiens
ccucucccgaguggugugaggggcu

SEQ ID NO: 4098 - RNA, 25 nt, Homo sapiens
cucucccgaguggugugaggggcug

SEQ ID NO: 4099 - RNA, 25 nt, Homo sapiens
ucccgaguggugugaggggcugggg

SEQ ID NO: 4100 - RNA, 25 nt, Homo sapiens
uggugugaggggcugggguggaaug

SEQ ID NO: 4101 - RNA, 25 nt, Homo sapiens
ugugaggggcugggguggaaugcgg

SEQ ID NO: 4102 - RNA, 25 nt, Homo sapiens
aggggcugggguggaaugcggcggc

SEQ ID NO: 4103 - RNA, 25 nt, Homo sapiens
ggcugggguggaaugcggcggcagg

SEQ ID NO: 4104 - RNA, 25 nt, Homo sapiens
augcggcggcaggaggccagagugc

SEQ ID NO: 4105 - RNA, 25 nt, Homo sapiens
ggcggcaggaggccagagugcuggc

SEQ ID NO: 4106 - RNA, 25 nt, Homo sapiens
gcggcaggaggccagagugcuggcu

SEQ ID NO: 4107 - RNA, 25 nt, Homo sapiens
ggccagagugcuggcugggccugaa

SEQ ID NO: 4108 - RNA, 25 nt, Homo sapiens
cugccucagcuucccugccccacaa

SEQ ID NO: 4109 - RNA, 25 nt, Homo sapiens
ugccucagcuucccugccccacaaa

SEQ ID NO: 4110 - RNA, 25 nt, Homo sapiens
gcuucccugccccacaaagggccug

SEQ ID NO: 4111 - RNA, 25 nt, Homo sapiens
cccacaaagggccugaggugcugcc

SEQ ID NO: 4112 - RNA, 25 nt, Homo sapiens
ccacaaagggccugaggugcugccu

SEQ ID NO: 4113 - RNA, 25 nt, Homo sapiens
ugaggugcugccugggcauguguaa

SEQ ID NO: 4114 - RNA, 25 nt, Homo sapiens
ggugcugccugggcauguguaaagg

SEQ ID NO: 4115 - RNA, 25 nt, Homo sapiens
gcugccugggcauguguaaaggugg

SEQ ID NO: 4116 - RNA, 25 nt, Homo sapiens
cugccugggcauguguaaaggugga

SEQ ID NO: 4117 - RNA, 25 nt, Homo sapiens
ugccugggcauguguaaagguggag

SEQ ID NO: 4118 - RNA, 25 nt, Homo sapiens
guuuccugcccugcccaccacagcc

SEQ ID NO: 4119 - RNA, 25 nt, Homo sapiens
uucugaccuucccugaaacuucucu

SEQ ID NO: 4120 - RNA, 25 nt, Homo sapiens
uucccugaaacuucucuaggccugc

SEQ ID NO: 4121 - RNA, 25 nt, Homo sapiens
ucccugaaacuucucuaggccugca

SEQ ID NO: 4122 - RNA, 25 nt, Homo sapiens
aggccugcagggagcagauaacucc

SEQ ID NO: 4123 - RNA, 25 nt, Homo sapiens
ggccugcagggagcagauaacuccu

SEQ ID NO: 4124 - RNA, 25 nt, Homo sapiens
gccugcagggagcagauaacuccug

SEQ ID NO: 4125 - RNA, 25 nt, Homo sapiens
uaccucccacuccugugcccagucu

SEQ ID NO: 4126 - RNA, 25 nt, Homo sapiens
accucccacuccugugcccagucuu

SEQ ID NO: 4127 - RNA, 25 nt, Homo sapiens
gugcccagucuugggcccugcgucc

SEQ ID NO: 4128 - RNA, 25 nt, Homo sapiens
ugcccagucuugggcccugcgucca

SEQ ID NO: 4129 - RNA, 25 nt, Homo sapiens
cuugggcccugcguccagggcguuu

SEQ ID NO: 4130 - RNA, 25 nt, Homo sapiens
uugggcccugcguccagggcguuuc

SEQ ID NO: 4131 - RNA, 25 nt, Homo sapiens
cagggcguuucgggaugccacugcc

SEQ ID NO: 4132 - RNA, 25 nt, Homo sapiens
agggcguuucgggaugccacugcca

SEQ ID NO: 4133 - RNA, 25 nt, Homo sapiens
gggcguuucgggaugccacugccag

SEQ ID NO: 4134 - RNA, 25 nt, Homo sapiens
cgggaugccacugccaggggcaccu

SEQ ID NO: 4135 - RNA, 25 nt, Homo sapiens
ugccaggggcaccuuggcugcucca

SEQ ID NO: 4136 - RNA, 25 nt, Homo sapiens
ccaucuccaaccagcccccaaguuc

SEQ ID NO: 4137 - RNA, 25 nt, Homo sapiens
cuccaaccagcccccaaguucaggc

SEQ ID NO: 4138 - RNA, 25 nt, Homo sapiens
caaccagcccccaaguucaggcagg

SEQ ID NO: 4139 - RNA, 25 nt, Homo sapiens
gcccccaaguucaggcaggaggcuc

SEQ ID NO: 4140 - RNA, 25 nt, Homo sapiens
cccccaaguucaggcaggaggcucc

SEQ ID NO: 4141 - RNA, 25 nt, Homo sapiens
ccccaaguucaggcaggaggcuccg

SEQ ID NO: 4142 - RNA, 25 nt, Homo sapiens
uucaggcaggaggcuccggggcguc

SEQ ID NO: 4143 - RNA, 25 nt, Homo sapiens
ggcaggaggcuccggggcgucaggc

SEQ ID NO: 4144 - RNA, 25 nt, Homo sapiens
gcaggaggcuccggggcgucaggca

SEQ ID NO: 4145 - RNA, 25 nt, Homo sapiens
ggcuccggggcgucaggcagggcca

SEQ ID NO: 4146 - RNA, 25 nt, Homo sapiens
ggcagggccacggcgccuucagccc

SEQ ID NO: 4147 - RNA, 25 nt, Homo sapiens
gcagggccacggcgccuucagcccc

SEQ ID NO: 4148 - RNA, 25 nt, Homo sapiens
gcagcagcagcagcagcagagauuc

SEQ ID NO: 4149 - RNA, 25 nt, Homo sapiens
cagcagcagcagcagcagagauuca

SEQ ID NO: 4150 - RNA, 25 nt, Homo sapiens
cagcagcagcagagauucagggagc

SEQ ID NO: 4151 - RNA, 25 nt, Homo sapiens
agcagagauucagggagcuggacgc

SEQ ID NO: 4152 - RNA, 25 nt, Homo sapiens
gagcuggacgcaggcagcucugugc

SEQ ID NO: 4153 - RNA, 25 nt, Homo sapiens
uggacgcaggcagcucugugcuggc

SEQ ID NO: 4154 - RNA, 25 nt, Homo sapiens
caggaccugaagcagugacugcauc

SEQ ID NO: 4155 - RNA, 25 nt, Homo sapiens
agugacugcaucuggcccucccugu

SEQ ID NO: 4156 - RNA, 25 nt, Homo sapiens
gugacugcaucuggcccucccugua

SEQ ID NO: 4157 - RNA, 25 nt, Homo sapiens
ugacugcaucuggcccucccuguag

SEQ ID NO: 4158 - RNA, 25 nt, Homo sapiens
ugcaucuggcccucccuguagggga

SEQ ID NO: 4159 - RNA, 25 nt, Homo sapiens
guaggggacggugacaccugcugcc

SEQ ID NO: 4160 - RNA, 25 nt, Homo sapiens
uaggggacggugacaccugcugccu

SEQ ID NO: 4161 - RNA, 25 nt, Homo sapiens
ugacaccugcugccugggcucacug

SEQ ID NO: 4162 - RNA, 25 nt, Homo sapiens
gacaccugcugccugggcucacugu

SEQ ID NO: 4163 - RNA, 25 nt, Homo sapiens
ugugggcauugagacaugaguccug

SEQ ID NO: 4164 - RNA, 25 nt, Homo sapiens
gggcauugagacaugaguccugugg

SEQ ID NO: 4165 - RNA, 25 nt, Homo sapiens
ggcauugagacaugaguccuguggu

SEQ ID NO: 4166 - RNA, 25 nt, Homo sapiens
gcauugagacaugaguccuguggug

SEQ ID NO: 4167 - RNA, 25 nt, Homo sapiens
augaguccugugguggggcugugcc

SEQ ID NO: 4168 - RNA, 25 nt, Homo sapiens
ccugugguggggcugugccuggugc

SEQ ID NO: 4169 - RNA, 25 nt, Homo sapiens
guggggcugugccuggugcaggugc

SEQ ID NO: 4170 - RNA, 25 nt, Homo sapiens
ggcugugccuggugcaggugcaggc

SEQ ID NO: 4171 - RNA, 25 nt, Homo sapiens
cuggugcaggugcaggcuggagccc

SEQ ID NO: 4172 - RNA, 25 nt, Homo sapiens
gcaggcuggagccccggucgccccc

SEQ ID NO: 4173 - RNA, 25 nt, Homo sapiens
ggucgcccccaggcagcucagcccc

SEQ ID NO: 4174 - RNA, 25 nt, Homo sapiens
gcccccaggcagcucagccccugga

SEQ ID NO: 4175 - RNA, 25 nt, Homo sapiens
agcucagccccuggacggccugcaa

SEQ ID NO: 4176 - RNA, 25 nt, Homo sapiens
gccugcacccugccugcuucuccug

SEQ ID NO: 4177 - RNA, 25 nt, Homo sapiens
cuucuccugaggaaaugcgcugacc

SEQ ID NO: 4178 - RNA, 25 nt, Homo sapiens
uucuccugaggaaaugcgcugaccc

SEQ ID NO: 4179 - RNA, 25 nt, Homo sapiens
gaggaaaugcgcugacccgggcuca

SEQ ID NO: 4180 - RNA, 25 nt, Homo sapiens
gaaaugcgcugacccgggcucaugg

SEQ ID NO: 4181 - RNA, 25 nt, Homo sapiens
augcgcugacccgggcucauggugg

SEQ ID NO: 4182 - RNA, 25 nt, Homo sapiens
ugcgcugacccgggcucauggugga

SEQ ID NO: 4183 - RNA, 25 nt, Homo sapiens
ucaugguggagggucugcagaacac

SEQ ID NO: 4184 - RNA, 25 nt, Homo sapiens
ugguggagggucugcagaacacugg

SEQ ID NO: 4185 - RNA, 25 nt, Homo sapiens
agggucugcagaacacugguggcca

SEQ ID NO: 4186 - RNA, 25 nt, Homo sapiens
gcagaacacugguggccaaggaagc

SEQ ID NO: 4187 - RNA, 25 nt, Homo sapiens
acugguggccaaggaagccggucag

SEQ ID NO: 4188 - RNA, 25 nt, Homo sapiens
cugguggccaaggaagccggucaga

SEQ ID NO: 4189 - RNA, 25 nt, Homo sapiens
ugguggccaaggaagccggucagag

SEQ ID NO: 4190 - RNA, 25 nt, Homo sapiens
ggggccaagagcaguguccauccuc

SEQ ID NO: 4191 - RNA, 25 nt, Homo sapiens
agcaguguccauccucaggccucag

SEQ ID NO: 4192 - RNA, 25 nt, Homo sapiens
guguccauccucaggccucaguggc

SEQ ID NO: 4193 - RNA, 25 nt, Homo sapiens
uguccauccucaggccucaguggcu

SEQ ID NO: 4194 - RNA, 25 nt, Homo sapiens
caggccucaguggcugggcacuccg

SEQ ID NO: 4195 - RNA, 25 nt, Homo sapiens
aggccucaguggcugggcacuccga

SEQ ID NO: 4196 - RNA, 25 nt, Homo sapiens
ccgagggccgucagcugagccccug

SEQ ID NO: 4197 - RNA, 25 nt, Homo sapiens
cgagggccgucagcugagccccugc

SEQ ID NO: 4198 - RNA, 25 nt, Homo sapiens
gggccgucagcugagccccugcggg

SEQ ID NO: 4199 - RNA, 25 nt, Homo sapiens
ggccgucagcugagccccugcgggc

SEQ ID NO: 4200 - RNA, 25 nt, Homo sapiens
gccgucagcugagccccugcgggcg

SEQ ID NO: 4201 - RNA, 25 nt, Homo sapiens
ccgucagcugagccccugcgggcgg

SEQ ID NO: 4202 - RNA, 25 nt, Homo sapiens
gcugagccccugcgggcgggggaug

SEQ ID NO: 4203 - RNA, 25 nt, Homo sapiens
cgggggaugaggugcccauuccgcu

SEQ ID NO: 4204 - RNA, 25 nt, Homo sapiens
gugcccauuccgcuaggaaagacaa

SEQ ID NO: 4205 - RNA, 25 nt, Homo sapiens
cccauuccgcuaggaaagacaaugg

SEQ ID NO: 4206 - RNA, 25 nt, Homo sapiens
caaugguggcauacuccgucugcuc

SEQ ID NO: 4207 - RNA, 25 nt, Homo sapiens
aaugguggcauacuccgucugcuca

SEQ ID NO: 4208 - RNA, 25 nt, Homo sapiens
gcauacuccgucugcucagggacac

SEQ ID NO: 4209 - RNA, 25 nt, Homo sapiens
cauacuccgucugcucagggacaca

SEQ ID NO: 4210 - RNA, 25 nt, Homo sapiens
uccgucugcucagggacacagggca

SEQ ID NO: 4211 - RNA, 25 nt, Homo sapiens
ccgucugcucagggacacagggcac

SEQ ID NO: 4212 - RNA, 25 nt, Homo sapiens
cgucugcucagggacacagggcacg

SEQ ID NO: 4213 - RNA, 25 nt, Homo sapiens
gucugcucagggacacagggcacgg

SEQ ID NO: 4214 - RNA, 25 nt, Homo sapiens
ucugcucagggacacagggcacggg

SEQ ID NO: 4215 - RNA, 25 nt, Homo sapiens
cagggacacagggcacggggggcuc

SEQ ID NO: 4216 - RNA, 25 nt, Homo sapiens
agggacacagggcacggggggcucc

SEQ ID NO: 4217 - RNA, 25 nt, Homo sapiens
gggacacagggcacggggggcuccg

SEQ ID NO: 4218 - RNA, 25 nt, Homo sapiens
gggcuccggggucuucucucgccac

SEQ ID NO: 4219 - RNA, 25 nt, Homo sapiens
gcuccccauaguccacagagaacac

SEQ ID NO: 4220 - RNA, 25 nt, Homo sapiens
ccauaguccacagagaacacaggca

SEQ ID NO: 4221 - RNA, 25 nt, Homo sapiens
uccacagagaacacaggcacggcug

SEQ ID NO: 4222 - RNA, 25 nt, Homo sapiens
ccacagagaacacaggcacggcuga

SEQ ID NO: 4223 - RNA, 25 nt, Homo sapiens
cacagagaacacaggcacggcugag

SEQ ID NO: 4224 - RNA, 25 nt, Homo sapiens
acggcugagggguccuccuucuuug

SEQ ID NO: 4225 - RNA, 25 nt, Homo sapiens
agggguccuccuucuuugaggagaa

SEQ ID NO: 4226 - RNA, 25 nt, Homo sapiens
gggguccuccuucuuugaggagaaa

SEQ ID NO: 4227 - RNA, 25 nt, Homo sapiens
ccuccuucuuugaggagaaagggag

SEQ ID NO: 4228 - RNA, 25 nt, Homo sapiens
cuccuucuuugaggagaaagggaga

SEQ ID NO: 4229 - RNA, 25 nt, Homo sapiens
ggaguucuguccugucugguggcug

SEQ ID NO: 4230 - RNA, 25 nt, Homo sapiens
ugcuaaggaguucuguccugucugg

SEQ ID NO: 4231 - RNA, 25 nt, Homo sapiens
gcaugcuaaggaguucuguccuguc

SEQ ID NO: 4232 - RNA, 25 nt, Homo sapiens
uauaauuaaauaugagagcaugcua

SEQ ID NO: 4233 - RNA, 25 nt, Homo sapiens
ugggacaagggaucccccuucccug

SEQ ID NO: 4234 - RNA, 25 nt, Homo sapiens
gcaggcaccugaguggcugggacaa

SEQ ID NO: 4235 - RNA, 25 nt, Homo sapiens
agcaggcaccugaguggcugggaca

SEQ ID NO: 4236 - RNA, 25 nt, Homo sapiens
gcggccagcaggcaccugaguggcu

SEQ ID NO: 4237 - RNA, 25 nt, Homo sapiens
ggcggccagcaggcaccugaguggc

SEQ ID NO: 4238 - RNA, 25 nt, Homo sapiens
uccaggcggccagcaggcaccugag

SEQ ID NO: 4239 - RNA, 25 nt, Homo sapiens
ggccaccagcauccaggcggccagc

SEQ ID NO: 4240 - RNA, 25 nt, Homo sapiens
uggggcagggccaccagcauccagg

SEQ ID NO: 4241 - RNA, 25 nt, Homo sapiens
uccuggggcagggccaccagcaucc

SEQ ID NO: 4242 - RNA, 25 nt, Homo sapiens
acacugcacccccacuccuggggca

SEQ ID NO: 4243 - RNA, 25 nt, Homo sapiens
cacacugcacccccacuccuggggc

SEQ ID NO: 4244 - RNA, 25 nt, Homo sapiens
uccacacacugcacccccacuccug

SEQ ID NO: 4245 - RNA, 25 nt, Homo sapiens
auccacacacugcacccccacuccu

SEQ ID NO: 4246 - RNA, 25 nt, Homo sapiens
cauccacacacugcacccccacucc

SEQ ID NO: 4247 - RNA, 25 nt, Homo sapiens
cccccggggccuaguacccccgccg

SEQ ID NO: 4248 - RNA, 25 nt, Homo sapiens
gugggaagguacaggcguucccccg

SEQ ID NO: 4249 - RNA, 25 nt, Homo sapiens
ggugggaagguacaggcguuccccc

SEQ ID NO: 4250 - RNA, 25 nt, Homo sapiens
gggugggaagguacaggcguucccc

SEQ ID NO: 4251 - RNA, 25 nt, Homo sapiens
caccagggccugggugggaagguac

SEQ ID NO: 4252 - RNA, 25 nt, Homo sapiens
ggcucccaccagggccuggguggga

SEQ ID NO: 4253 - RNA, 25 nt, Homo sapiens
gccgggcucccaccagggccugggu

SEQ ID NO: 4254 - RNA, 25 nt, Homo sapiens
ggccgggcucccaccagggccuggg

SEQ ID NO: 4255 - RNA, 25 nt, Homo sapiens
guuggccgggcucccaccagggccu

SEQ ID NO: 4256 - RNA, 25 nt, Homo sapiens
gguuggccgggcucccaccagggcc

SEQ ID NO: 4257 - RNA, 25 nt, Homo sapiens
aaagggguuggccgggcucccacca

SEQ ID NO: 4258 - RNA, 25 nt, Homo sapiens
uaaagggguuggccgggcucccacc

SEQ ID NO: 4259 - RNA, 25 nt, Homo sapiens
cugaaauuauuuaaagggguuggcc

SEQ ID NO: 4260 - RNA, 25 nt, Homo sapiens
ccugaaauuauuuaaagggguuggc

SEQ ID NO: 4261 - RNA, 25 nt, Homo sapiens
cauuccugaaauuauuuaaaggggu

SEQ ID NO: 4262 - RNA, 25 nt, Homo sapiens
aacccauuccugaaauuauuuaaag

SEQ ID NO: 4263 - RNA, 25 nt, Homo sapiens
gaacccauuccugaaauuauuuaaa

SEQ ID NO: 4264 - RNA, 25 nt, Homo sapiens
ggaacccauuccugaaauuauuuaa

SEQ ID NO: 4265 - RNA, 25 nt, Homo sapiens
augugcccacccugggagcucuccu

SEQ ID NO: 4266 - RNA, 25 nt, Homo sapiens
cuagggccccccaugugcccacccu

SEQ ID NO: 4267 - RNA, 25 nt, Homo sapiens
ccuagggccccccaugugcccaccc

SEQ ID NO: 4268 - RNA, 25 nt, Homo sapiens
gggagggcagaagugcaggcaccua

SEQ ID NO: 4269 - RNA, 25 nt, Homo sapiens
ugggagggcagaagugcaggcaccu

SEQ ID NO: 4270 - RNA, 25 nt, Homo sapiens
cuggguguugggagggcagaagugc

SEQ ID NO: 4271 - RNA, 25 nt, Homo sapiens
agcuguggccaccuggguguuggga

SEQ ID NO: 4272 - RNA, 25 nt, Homo sapiens
cagcuguggccaccuggguguuggg

SEQ ID NO: 4273 - RNA, 25 nt, Homo sapiens
ucccagcuguggccaccuggguguu

SEQ ID NO: 4274 - RNA, 25 nt, Homo sapiens
cucccagcuguggccaccugggugu

SEQ ID NO: 4275 - RNA, 25 nt, Homo sapiens
aggccccucccagcuguggccaccu

SEQ ID NO: 4276 - RNA, 25 nt, Homo sapiens
caggccccucccagcuguggccacc

SEQ ID NO: 4277 - RNA, 25 nt, Homo sapiens
gguugacucaggccccucccagcug

SEQ ID NO: 4278 - RNA, 25 nt, Homo sapiens
aggagggcagggcugggguugacuc

SEQ ID NO: 4279 - RNA, 25 nt, Homo sapiens
ucccaaggucaggagggcagggcug

SEQ ID NO: 4280 - RNA, 25 nt, Homo sapiens
gucccaaggucaggagggcagggcu

SEQ ID NO: 4281 - RNA, 25 nt, Homo sapiens
ggucccaaggucaggagggcagggc

SEQ ID NO: 4282 - RNA, 25 nt, Homo sapiens
cuacggucccaaggucaggagggca

SEQ ID NO: 4283 - RNA, 25 nt, Homo sapiens
ccuacggucccaaggucaggagggc

SEQ ID NO: 4284 - RNA, 25 nt, Homo sapiens
acauccuacggucccaaggucagga

SEQ ID NO: 4285 - RNA, 25 nt, Homo sapiens
gacauccuacggucccaaggucagg

SEQ ID NO: 4286 - RNA, 25 nt, Homo sapiens
agggacauccuacggucccaagguc

SEQ ID NO: 4287 - RNA, 25 nt, Homo sapiens
gggagagggacauccuacgguccca

SEQ ID NO: 4288 - RNA, 25 nt, Homo sapiens
caccacucgggagagggacauccua

SEQ ID NO: 4289 - RNA, 25 nt, Homo sapiens
ccagccccucacaccacucgggaga

SEQ ID NO: 4290 - RNA, 25 nt, Homo sapiens
cccagccccucacaccacucgggag

SEQ ID NO: 4291 - RNA, 25 nt, Homo sapiens
uccaccccagccccucacaccacuc

SEQ ID NO: 4292 - RNA, 25 nt, Homo sapiens
uuccaccccagccccucacaccacu

SEQ ID NO: 4293 - RNA, 25 nt, Homo sapiens
ggccuuucaggcccagccagcacuc

SEQ ID NO: 4294 - RNA, 25 nt, Homo sapiens
gggcaggcagagcuggaggccuuuc

SEQ ID NO: 4295 - RNA, 25 nt, Homo sapiens
gcaguaagcgggcaggcagagcugg

SEQ ID NO: 4296 - RNA, 25 nt, Homo sapiens
gaggcaguaagcgggcaggcagagc

SEQ ID NO: 4297 - RNA, 25 nt, Homo sapiens
agggaagcugaggcaguaagcgggc

SEQ ID NO: 4298 - RNA, 25 nt, Homo sapiens
gggcagggaagcugaggcaguaagc

SEQ ID NO: 4299 - RNA, 25 nt, Homo sapiens
ggggcagggaagcugaggcaguaag

SEQ ID NO: 4300 - RNA, 25 nt, Homo sapiens
ggcccuuuguggggcagggaagcug

SEQ ID NO: 4301 - RNA, 25 nt, Homo sapiens
agcaccucaggcccuuuguggggca

SEQ ID NO: 4302 - RNA, 25 nt, Homo sapiens
cagcaccucaggcccuuuguggggc

SEQ ID NO: 4303 - RNA, 25 nt, Homo sapiens
caggcagcaccucaggcccuuugug

SEQ ID NO: 4304 - RNA, 25 nt, Homo sapiens
ccaggcagcaccucaggcccuuugu

SEQ ID NO: 4305 - RNA, 25 nt, Homo sapiens
cccaggcagcaccucaggcccuuug

SEQ ID NO: 4306 - RNA, 25 nt, Homo sapiens
uuuacacaugcccaggcagcaccuc

SEQ ID NO: 4307 - RNA, 25 nt, Homo sapiens
aaccccuccaccuuuacacaugccc

SEQ ID NO: 4308 - RNA, 25 nt, Homo sapiens
agcuccuggcuguggugggcagggc

SEQ ID NO: 4309 - RNA, 25 nt, Homo sapiens
gaagagcuccuggcuguggugggca

SEQ ID NO: 4310 - RNA, 25 nt, Homo sapiens
agaagagcuccuggcuguggugggc

SEQ ID NO: 4311 - RNA, 25 nt, Homo sapiens
ggucagaagagcuccuggcuguggu

SEQ ID NO: 4312 - RNA, 25 nt, Homo sapiens
aggucagaagagcuccuggcugugg

SEQ ID NO: 4313 - RNA, 25 nt, Homo sapiens
ggaaggucagaagagcuccuggcug

SEQ ID NO: 4314 - RNA, 25 nt, Homo sapiens
uuucagggaaggucagaagagcucc

SEQ ID NO: 4315 - RNA, 25 nt, Homo sapiens
ugcaggccuagagaaguuucaggga

SEQ ID NO: 4316 - RNA, 25 nt, Homo sapiens
ucccugcaggccuagagaaguuuca

SEQ ID NO: 4317 - RNA, 25 nt, Homo sapiens
cucccugcaggccuagagaaguuuc

SEQ ID NO: 4318 - RNA, 25 nt, Homo sapiens
uccccaggaguuaucugcucccugc

SEQ ID NO: 4319 - RNA, 25 nt, Homo sapiens
agguacauggggcuggggacucccc

SEQ ID NO: 4320 - RNA, 25 nt, Homo sapiens
caggagugggagguacauggggcug

SEQ ID NO: 4321 - RNA, 25 nt, Homo sapiens
acaggagugggagguacauggggcu

SEQ ID NO: 4322 - RNA, 25 nt, Homo sapiens
cacaggagugggagguacauggggc

SEQ ID NO: 4323 - RNA, 25 nt, Homo sapiens
ugggcacaggagugggagguacaug

SEQ ID NO: 4324 - RNA, 25 nt, Homo sapiens
cugggcacaggagugggagguacau

SEQ ID NO: 4325 - RNA, 25 nt, Homo sapiens
acugggcacaggagugggagguaca

SEQ ID NO: 4326 - RNA, 25 nt, Homo sapiens
gcccaagacugggcacaggaguggg

SEQ ID NO: 4327 - RNA, 25 nt, Homo sapiens
agggcccaagacugggcacaggagu

SEQ ID NO: 4328 - RNA, 25 nt, Homo sapiens
cagggcccaagacugggcacaggag

SEQ ID NO: 4329 - RNA, 25 nt, Homo sapiens
ggacgcagggcccaagacugggcac

SEQ ID NO: 4330 - RNA, 25 nt, Homo sapiens
cgcccuggacgcagggcccaagacu

SEQ ID NO: 4331 - RNA, 25 nt, Homo sapiens
acgcccuggacgcagggcccaagac

SEQ ID NO: 4332 - RNA, 25 nt, Homo sapiens
ggcaucccgaaacgcccuggacgca

SEQ ID NO: 4333 - RNA, 25 nt, Homo sapiens
uggcaucccgaaacgcccuggacgc

SEQ ID NO: 4334 - RNA, 25 nt, Homo sapiens
cuggcaguggcaucccgaaacgccc

SEQ ID NO: 4335 - RNA, 25 nt, Homo sapiens
ggagcagccaaggugccccuggcag

SEQ ID NO: 4336 - RNA, 25 nt, Homo sapiens
ggccuuggagcagccaaggugcccc

SEQ ID NO: 4337 - RNA, 25 nt, Homo sapiens
guuggagauggccuuggagcagcca

SEQ ID NO: 4338 - RNA, 25 nt, Homo sapiens
cuugggggcugguuggagauggccu

SEQ ID NO: 4339 - RNA, 25 nt, Homo sapiens
ccugaacuugggggcugguuggaga

SEQ ID NO: 4340 - RNA, 25 nt, Homo sapiens
cuccugccugaacuugggggcuggu

SEQ ID NO: 4341 - RNA, 25 nt, Homo sapiens
gagccuccugccugaacuugggggc

SEQ ID NO: 4342 - RNA, 25 nt, Homo sapiens
cccggagccuccugccugaacuugg

SEQ ID NO: 4343 - RNA, 25 nt, Homo sapiens
ccccggagccuccugccugaacuug

SEQ ID NO: 4344 - RNA, 25 nt, Homo sapiens
gccccggagccuccugccugaacuu

SEQ ID NO: 4345 - RNA, 25 nt, Homo sapiens
cgccccggagccuccugccugaacu

SEQ ID NO: 4346 - RNA, 25 nt, Homo sapiens
ggcgccguggcccugccugacgccc

SEQ ID NO: 4347 - RNA, 25 nt, Homo sapiens
cugcggcccggggcugaaggcgccg

SEQ ID NO: 4348 - RNA, 25 nt, Homo sapiens
cgacgacgcugcggcccggggcuga

SEQ ID NO: 4349 - RNA, 25 nt, Homo sapiens
acgacgacgacgacgcugcggcccg

SEQ ID NO: 4350 - RNA, 25 nt, Homo sapiens
gacgacgacgacgacgcugcggccc

SEQ ID NO: 4351 - RNA, 25 nt, Homo sapiens
cgacgacgacgacgacgcugcggcc

SEQ ID NO: 4352 - RNA, 25 nt, Homo sapiens
gacgacgacgacgacgacgacgcug

SEQ ID NO: 4353 - RNA, 25 nt, Homo sapiens
gagggccagaugcagucacugcuuc

SEQ ID NO: 4354 - RNA, 25 nt, Homo sapiens
caggugucaccguccccuacaggga

SEQ ID NO: 4355 - RNA, 25 nt, Homo sapiens
gcaggugucaccguccccuacaggg

SEQ ID NO: 4356 - RNA, 25 nt, Homo sapiens
gcagcaggugucaccguccccuaca

SEQ ID NO: 4357 - RNA, 25 nt, Homo sapiens
ggcagcaggugucaccguccccuac

SEQ ID NO: 4358 - RNA, 25 nt, Homo sapiens
aaugcccacagugagcccaggcagc

SEQ ID NO: 4359 - RNA, 25 nt, Homo sapiens
augucucaaugcccacagugagccc

SEQ ID NO: 4360 - RNA, 25 nt, Homo sapiens
ccugcaccaggcacagccccaccac

SEQ ID NO: 4361 - RNA, 25 nt, Homo sapiens
cggggcuccagccugcaccugcacc

SEQ ID NO: 4362 - RNA, 25 nt, Homo sapiens
gggcugagcugccugggggcgaccg

SEQ ID NO: 4363 - RNA, 25 nt, Homo sapiens
ggggcugagcugccugggggcgacc

SEQ ID NO: 4364 - RNA, 25 nt, Homo sapiens
aggggcugagcugccugggggcgac

SEQ ID NO: 4365 - RNA, 25 nt, Homo sapiens
gccguccaggggcugagcugccugg

SEQ ID NO: 4366 - RNA, 25 nt, Homo sapiens
ggccguccaggggcugagcugccug

SEQ ID NO: 4367 - RNA, 25 nt, Homo sapiens
aggccguccaggggcugagcugccu

SEQ ID NO: 4368 - RNA, 25 nt, Homo sapiens
caggccguccaggggcugagcugcc

SEQ ID NO: 4369 - RNA, 25 nt, Homo sapiens
gugcaggccauugcaggccguccag

SEQ ID NO: 4370 - RNA, 25 nt, Homo sapiens
ggugcaggccauugcaggccgucca

SEQ ID NO: 4371 - RNA, 25 nt, Homo sapiens
gggugcaggccauugcaggccgucc

SEQ ID NO: 4372 - RNA, 25 nt, Homo sapiens
aagcaggcagggugcaggccauugc

SEQ ID NO: 4373 - RNA, 25 nt, Homo sapiens
uccucaggagaagcaggcagggugc

SEQ ID NO: 4374 - RNA, 25 nt, Homo sapiens
cgcauuuccucaggagaagcaggca

SEQ ID NO: 4375 - RNA, 25 nt, Homo sapiens
gcgcauuuccucaggagaagcaggc

SEQ ID NO: 4376 - RNA, 25 nt, Homo sapiens
gucagcgcauuuccucaggagaagc

SEQ ID NO: 4377 - RNA, 25 nt, Homo sapiens
ugagcccgggucagcgcauuuccuc

SEQ ID NO: 4378 - RNA, 25 nt, Homo sapiens
ucugcagacccuccaccaugagccc

SEQ ID NO: 4379 - RNA, 25 nt, Homo sapiens
uucugcagacccuccaccaugagcc

SEQ ID NO: 4380 - RNA, 25 nt, Homo sapiens
ucuuggccccucugaccggcuuccu

SEQ ID NO: 4381 - RNA, 25 nt, Homo sapiens
ggacacugcucuuggccccucugac

SEQ ID NO: 4382 - RNA, 25 nt, Homo sapiens
gaggccugaggauggacacugcucu

SEQ ID NO: 4383 - RNA, 25 nt, Homo sapiens
gugcccagccacugaggccugagga

SEQ ID NO: 4384 - RNA, 25 nt, Homo sapiens
cggagugcccagccacugaggccug

SEQ ID NO: 4385 - RNA, 25 nt, Homo sapiens
cggcccucggagugcccagccacug

SEQ ID NO: 4386 - RNA, 25 nt, Homo sapiens
ccgcaggggcucagcugacggcccu

SEQ ID NO: 4387 - RNA, 25 nt, Homo sapiens
cccccgcccgcaggggcucagcuga

SEQ ID NO: 4388 - RNA, 25 nt, Homo sapiens
ugggcaccucaucccccgcccgcag

SEQ ID NO: 4389 - RNA, 25 nt, Homo sapiens
augggcaccucaucccccgcccgca

SEQ ID NO: 4390 - RNA, 25 nt, Homo sapiens
aaugggcaccucaucccccgcccgc

SEQ ID NO: 4391 - RNA, 25 nt, Homo sapiens
ccaccauugucuuuccuagcggaau

SEQ ID NO: 4392 - RNA, 25 nt, Homo sapiens
gccaccauugucuuuccuagcggaa

SEQ ID NO: 4393 - RNA, 25 nt, Homo sapiens
aguaugccaccauugucuuuccuag

SEQ ID NO: 4394 - RNA, 25 nt, Homo sapiens
cccgugcccugugucccugagcaga

SEQ ID NO: 4395 - RNA, 25 nt, Homo sapiens
gauuuccaguggcgagagaagaccc

SEQ ID NO: 4396 - RNA, 25 nt, Homo sapiens
ggacuauggggagcuggauuuccag

SEQ ID NO: 4397 - RNA, 25 nt, Homo sapiens
guguucucuguggacuauggggagc

SEQ ID NO: 4398 - RNA, 25 nt, Homo sapiens
gugccuguguucucuguggacuaug

SEQ ID NO: 4399 - RNA, 25 nt, Homo sapiens
cgugccuguguucucuguggacuau

SEQ ID NO: 4400 - RNA, 25 nt, Homo sapiens
ccgugccuguguucucuguggacua

SEQ ID NO: 4401 - RNA, 25 nt, Homo sapiens
cccucagccgugccuguguucucug

SEQ ID NO: 4402 - RNA, 25 nt, Homo sapiens
ccucucccuuucuccucaaagaagg

SEQ ID NO: 4403 - RNA, 25 nt, Homo sapiens
cucccucucccuuucuccucaaaga

SEQ ID NO: 4404 - RNA, 25 nt, Homo sapiens
augcaggaaaagagugagacucacc

SEQ ID NO: 4405 - RNA, 25 nt, Homo sapiens
ugcaggaaaagagugagacucacca

SEQ ID NO: 4406 - RNA, 25 nt, Homo sapiens
gcaggaaaagagugagacucaccag

SEQ ID NO: 4407 - RNA, 25 nt, Homo sapiens
gaaaagagugagacucaccaggggc

SEQ ID NO: 4408 - RNA, 25 nt, Homo sapiens
agagugagacucaccaggggcuggc

SEQ ID NO: 4409 - RNA, 25 nt, Homo sapiens
cucaccaggggcuggccggugcgcc

SEQ ID NO: 4410 - RNA, 25 nt, Homo sapiens
uauugucccugcagagaaacacacu

SEQ ID NO: 4411 - RNA, 25 nt, Homo sapiens
auugucccugcagagaaacacacuu

SEQ ID NO: 4412 - RNA, 25 nt, Homo sapiens
uugucccugcagagaaacacacuug

SEQ ID NO: 4413 - RNA, 25 nt, Homo sapiens
ggagccaggcgcaccggccagcccc

SEQ ID NO: 4414 - RNA, 25 nt, Homo sapiens
cagggacaauaggagccaggcgcac

SEQ ID NO: 4415 - RNA, 25 nt, Homo sapiens
uuucucugcagggacaauaggagcc

SEQ ID NO: 4416 - RNA, 25 nt, Homo sapiens
aaguguguuucucugcagggacaau

SEQ ID NO: 4417 - RNA, 25 nt, Homo sapiens
ggggcugggaugacguuaccucgug

SEQ ID NO: 4418 - RNA, 25 nt, Homo sapiens
ugggaugacguuaccucgugcggcc

SEQ ID NO: 4419 - RNA, 25 nt, Homo sapiens
gggaugacguuaccucgugcggccc

SEQ ID NO: 4420 - RNA, 25 nt, Homo sapiens
ccucgugcggcccgggagcagauga

SEQ ID NO: 4421 - RNA, 25 nt, Homo sapiens
ugcggcccgggagcagaugacggcc

SEQ ID NO: 4422 - RNA, 25 nt, Homo sapiens
ggccaggacccagacuagcagcacc

SEQ ID NO: 4423 - RNA, 25 nt, Homo sapiens
gacuagcagcaccaggcugcccagc

SEQ ID NO: 4424 - RNA, 25 nt, Homo sapiens
caggccgcccacgacaccaaccacc

SEQ ID NO: 4425 - RNA, 25 nt, Homo sapiens
aggccgcccacgacaccaaccacca

SEQ ID NO: 4426 - RNA, 25 nt, Homo sapiens
gcccacgacaccaaccaccaggguu

SEQ ID NO: 4427 - RNA, 25 nt, Homo sapiens
gacaccaaccaccaggguuuggaac

SEQ ID NO: 4428 - RNA, 25 nt, Homo sapiens
cugggugaggggcuggggugggcug

SEQ ID NO: 4429 - RNA, 25 nt, Homo sapiens
ugggugaggggcuggggugggcugu

SEQ ID NO: 4430 - RNA, 25 nt, Homo sapiens
cugugggcacuucugcccuucucuc

SEQ ID NO: 4431 - RNA, 25 nt, Homo sapiens
gggcacuucugcccuucucucugga

SEQ ID NO: 4432 - RNA, 25 nt, Homo sapiens
ggcacuucugcccuucucucuggaa

SEQ ID NO: 4433 - RNA, 25 nt, Homo sapiens
ccgucaucugcucccgggccgcacg

SEQ ID NO: 4434 - RNA, 25 nt, Homo sapiens
uggguccuggccgucaucugcuccc

SEQ ID NO: 4435 - RNA, 25 nt, Homo sapiens
cuggguccuggccgucaucugcucc

SEQ ID NO: 4436 - RNA, 25 nt, Homo sapiens
agccuggugcugcuagucugggucc

SEQ ID NO: 4437 - RNA, 25 nt, Homo sapiens
cugggcagccuggugcugcuagucu

SEQ ID NO: 4438 - RNA, 25 nt, Homo sapiens
gcugggcagccuggugcugcuaguc

SEQ ID NO: 4439 - RNA, 25 nt, Homo sapiens
gucgugggcggccugcugggcagcc

SEQ ID NO: 4440 - RNA, 25 nt, Homo sapiens
ugguuggugucgugggcggccugcu

SEQ ID NO: 4441 - RNA, 25 nt, Homo sapiens
gugguuggugucgugggcggccugc

SEQ ID NO: 4442 - RNA, 25 nt, Homo sapiens
aaacccuggugguuggugucguggg

SEQ ID NO: 4443 - RNA, 25 nt, Homo sapiens
uccaaacccuggugguuggugucgu

SEQ ID NO: 4444 - RNA, 25 nt, Homo sapiens
uuccaaacccuggugguuggugucg

SEQ ID NO: 4445 - RNA, 25 nt, Homo sapiens
ggggccaguuccaaacccugguggu

SEQ ID NO: 4446 - RNA, 25 nt, Homo sapiens
ggucggggccaguuccaaacccugg

SEQ ID NO: 4447 - RNA, 25 nt, Homo sapiens
uccggucggggccaguuccaaaccc

SEQ ID NO: 4448 - RNA, 25 nt, Homo sapiens
uggggucggggaguggguccggucg

SEQ ID NO: 4449 - RNA, 25 nt, Homo sapiens
cugguuugugcccuuccagagagaa

SEQ ID NO: 4450 - RNA, 25 nt, Homo sapiens
acugguuugugcccuuccagagaga

SEQ ID NO: 4451 - RNA, 25 nt, Homo sapiens
accugucacccugagcucugcccgc

SEQ ID NO: 4452 - RNA, 25 nt, Homo sapiens
cgcaggcucucuuugaucugcgccu

SEQ ID NO: 4453 - RNA, 25 nt, Homo sapiens
gcaggcucucuuugaucugcgccuu

SEQ ID NO: 4454 - RNA, 25 nt, Homo sapiens
caggcucucuuugaucugcgccuug

SEQ ID NO: 4455 - RNA, 25 nt, Homo sapiens
aggcucucuuugaucugcgccuugg

SEQ ID NO: 4456 - RNA, 25 nt, Homo sapiens
cucuuugaucugcgccuugggggcc

SEQ ID NO: 4457 - RNA, 25 nt, Homo sapiens
ucuuugaucugcgccuugggggcca

SEQ ID NO: 4458 - RNA, 25 nt, Homo sapiens
aucugcgccuugggggccagggaga

SEQ ID NO: 4459 - RNA, 25 nt, Homo sapiens
gggggccagggagauggccccacag

SEQ ID NO: 4460 - RNA, 25 nt, Homo sapiens
gccagggagauggccccacagaggu

SEQ ID NO: 4461 - RNA, 25 nt, Homo sapiens
gagguaggugccgcugucauugcgc

SEQ ID NO: 4462 - RNA, 25 nt, Homo sapiens
agguaggugccgcugucauugcgcc

SEQ ID NO: 4463 - RNA, 25 nt, Homo sapiens
gcgccgggcccugaccacgcucaug

SEQ ID NO: 4464 - RNA, 25 nt, Homo sapiens
acgcucauguggaagucacgcccgu

SEQ ID NO: 4465 - RNA, 25 nt, Homo sapiens
cgcucauguggaagucacgcccguu

SEQ ID NO: 4466 - RNA, 25 nt, Homo sapiens
acgcccguugggcaguugugugaca

SEQ ID NO: 4467 - RNA, 25 nt, Homo sapiens
guugggcaguugugugacacggaag

SEQ ID NO: 4468 - RNA, 25 nt, Homo sapiens
uugugugacacggaagcggcagucc

SEQ ID NO: 4469 - RNA, 25 nt, Homo sapiens
gugacacggaagcggcaguccuggc

SEQ ID NO: 4470 - RNA, 25 nt, Homo sapiens
ugacacggaagcggcaguccuggcc

SEQ ID NO: 4471 - RNA, 25 nt, Homo sapiens
acggaagcggcaguccuggccgggc

SEQ ID NO: 4472 - RNA, 25 nt, Homo sapiens
gcggcaguccuggccgggcuggcug

SEQ ID NO: 4473 - RNA, 25 nt, Homo sapiens
uccuggccgggcuggcugcgguccu

SEQ ID NO: 4474 - RNA, 25 nt, Homo sapiens
ccuggccgggcuggcugcgguccuc

SEQ ID NO: 4475 - RNA, 25 nt, Homo sapiens
cuggccgggcuggcugcgguccucg

SEQ ID NO: 4476 - RNA, 25 nt, Homo sapiens
ccgggcuggcugcgguccucgggga

SEQ ID NO: 4477 - RNA, 25 nt, Homo sapiens
ggcuggcugcgguccucggggaagg

SEQ ID NO: 4478 - RNA, 25 nt, Homo sapiens
ggggaaggcggccagcuuguccguc

SEQ ID NO: 4479 - RNA, 25 nt, Homo sapiens
gcggccagcuuguccgucugguugc

SEQ ID NO: 4480 - RNA, 25 nt, Homo sapiens
cggccagcuuguccgucugguugcu

SEQ ID NO: 4481 - RNA, 25 nt, Homo sapiens
ggccagcuuguccgucugguugcug

SEQ ID NO: 4482 - RNA, 25 nt, Homo sapiens
guccgucugguugcuggggcucaug

SEQ ID NO: 4483 - RNA, 25 nt, Homo sapiens
uuuagcacgaagcucuccgaugugu

SEQ ID NO: 4484 - RNA, 25 nt, Homo sapiens
cucuccgauguguuggagaagcugc

SEQ ID NO: 4485 - RNA, 25 nt, Homo sapiens
gauguguuggagaagcugcagguga

SEQ ID NO: 4486 - RNA, 25 nt, Homo sapiens
guguuggagaagcugcaggugaagg

SEQ ID NO: 4487 - RNA, 25 nt, Homo sapiens
caggugaagguggcguuguccccuu

SEQ ID NO: 4488 - RNA, 25 nt, Homo sapiens
guuguccccuucggucaccacgagc

SEQ ID NO: 4489 - RNA, 25 nt, Homo sapiens
uuguccccuucggucaccacgagca

SEQ ID NO: 4490 - RNA, 25 nt, Homo sapiens
ccccuucggucaccacgagcagggc

SEQ ID NO: 4491 - RNA, 25 nt, Homo sapiens
cccuucggucaccacgagcagggcu

SEQ ID NO: 4492 - RNA, 25 nt, Homo sapiens
ccuucggucaccacgagcagggcug

SEQ ID NO: 4493 - RNA, 25 nt, Homo sapiens
gucaccacgagcagggcuggggaga

SEQ ID NO: 4494 - RNA, 25 nt, Homo sapiens
accacgagcagggcuggggagaagg

SEQ ID NO: 4495 - RNA, 25 nt, Homo sapiens
ccacgagcagggcuggggagaaggu

SEQ ID NO: 4496 - RNA, 25 nt, Homo sapiens
cacgagcagggcuggggagaaggug

SEQ ID NO: 4497 - RNA, 25 nt, Homo sapiens
acgagcagggcuggggagaaggugg

SEQ ID NO: 4498 - RNA, 25 nt, Homo sapiens
cgagcagggcuggggagaagguggg

SEQ ID NO: 4499 - RNA, 25 nt, Homo sapiens
gagcagggcuggggagaaggugggg

SEQ ID NO: 4500 - RNA, 25 nt, Homo sapiens
gcuggggagaagguggggggguucc

SEQ ID NO: 4501 - RNA, 25 nt, Homo sapiens
cuggggagaagguggggggguucca

SEQ ID NO: 4502 - RNA, 25 nt, Homo sapiens
agguggggggguuccagggccuguc

SEQ ID NO: 4503 - RNA, 25 nt, Homo sapiens
gguggggggguuccagggccugucu

SEQ ID NO: 4504 - RNA, 25 nt, Homo sapiens
guggggggguuccagggccugucug

SEQ ID NO: 4505 - RNA, 25 nt, Homo sapiens
gggccugucuggggagucugagaga

SEQ ID NO: 4506 - RNA, 25 nt, Homo sapiens
ucuggggagucugagagauggagag

SEQ ID NO: 4507 - RNA, 25 nt, Homo sapiens
ggagucugagagauggagagaggug

SEQ ID NO: 4508 - RNA, 25 nt, Homo sapiens
gacaggugcggccucggaggccccg

SEQ ID NO: 4509 - RNA, 25 nt, Homo sapiens
ugacaggugcggccucggaggcccc

SEQ ID NO: 4510 - RNA, 25 nt, Homo sapiens
gugacaggugcggccucggaggccc

SEQ ID NO: 4511 - RNA, 25 nt, Homo sapiens
cucagggugacaggugcggccucgg

SEQ ID NO: 4512 - RNA, 25 nt, Homo sapiens
gagcucagggugacaggugcggccu

SEQ ID NO: 4513 - RNA, 25 nt, Homo sapiens
cgggcagagcucagggugacaggug

SEQ ID NO: 4514 - RNA, 25 nt, Homo sapiens
gccugcgggcagagcucagggugac

SEQ ID NO: 4515 - RNA, 25 nt, Homo sapiens
aaagagagccugcgggcagagcuca

SEQ ID NO: 4516 - RNA, 25 nt, Homo sapiens
caaagagagccugcgggcagagcuc

SEQ ID NO: 4517 - RNA, 25 nt, Homo sapiens
aaggcgcagaucaaagagagccugc

SEQ ID NO: 4518 - RNA, 25 nt, Homo sapiens
caaggcgcagaucaaagagagccug

SEQ ID NO: 4519 - RNA, 25 nt, Homo sapiens
uguggggccaucucccuggccccca

SEQ ID NO: 4520 - RNA, 25 nt, Homo sapiens
accuaccucuguggggccaucuccc

SEQ ID NO: 4521 - RNA, 25 nt, Homo sapiens
aaugacagcggcaccuaccucugug

SEQ ID NO: 4522 - RNA, 25 nt, Homo sapiens
caaugacagcggcaccuaccucugu

SEQ ID NO: 4523 - RNA, 25 nt, Homo sapiens
gcaaugacagcggcaccuaccucug

SEQ ID NO: 4524 - RNA, 25 nt, Homo sapiens
uggucagggcccggcgcaaugacag

SEQ ID NO: 4525 - RNA, 25 nt, Homo sapiens
cuuccacaugagcguggucagggcc

SEQ ID NO: 4526 - RNA, 25 nt, Homo sapiens
cgugacuuccacaugagcgugguca

SEQ ID NO: 4527 - RNA, 25 nt, Homo sapiens
gcgugacuuccacaugagcgugguc

SEQ ID NO: 4528 - RNA, 25 nt, Homo sapiens
aacgggcgugacuuccacaugagcg

SEQ ID NO: 4529 - RNA, 25 nt, Homo sapiens
cuuccgugucacacaacugcccaac

SEQ ID NO: 4530 - RNA, 25 nt, Homo sapiens
gcuuccgugucacacaacugcccaa

SEQ ID NO: 4531 - RNA, 25 nt, Homo sapiens
cccgaggaccgcagccagcccggcc

SEQ ID NO: 4532 - RNA, 25 nt, Homo sapiens
ccuuccccgaggaccgcagccagcc

SEQ ID NO: 4533 - RNA, 25 nt, Homo sapiens
acggacaagcuggccgccuuccccg

SEQ ID NO: 4534 - RNA, 25 nt, Homo sapiens
agccccagcaaccagacggacaagc

SEQ ID NO: 4535 - RNA, 25 nt, Homo sapiens
uaccgcaugagccccagcaaccaga

SEQ ID NO: 4536 - RNA, 25 nt, Homo sapiens
cacaucggagagcuucgugcuaaac

SEQ ID NO: 4537 - RNA, 25 nt, Homo sapiens
uucaccugcagcuucuccaacacau

SEQ ID NO: 4538 - RNA, 25 nt, Homo sapiens
ccagcccugcucguggugaccgaag

SEQ ID NO: 4539 - RNA, 25 nt, Homo sapiens
cccagcccugcucguggugaccgaa

SEQ ID NO: 4540 - RNA, 25 nt, Homo sapiens
ccccagcccugcucguggugaccga

SEQ ID NO: 4541 - RNA, 25 nt, Homo sapiens
cccaccuucuccccagcccugcucg

SEQ ID NO: 4542 - RNA, 25 nt, Homo sapiens
ucucucagacuccccagacaggccc

SEQ ID NO: 4543 - RNA, 25 nt, Homo sapiens
ucuccaucucucagacuccccagac

SEQ ID NO: 4544 - RNA, 25 nt, Homo sapiens
gaccccaccuaccuaagaaccaucc

SEQ ID NO: 4545 - RNA, 25 nt, Homo sapiens
ccaguuguagcaccgcccagacgac

SEQ ID NO: 4546 - RNA, 25 nt, Homo sapiens
uguagcaccgcccagacgacuggcc

SEQ ID NO: 4547 - RNA, 25 nt, Homo sapiens
guagcaccgcccagacgacuggcca

SEQ ID NO: 4548 - RNA, 25 nt, Homo sapiens
cccagacgacuggccagggcgccug

SEQ ID NO: 4549 - RNA, 25 nt, Homo sapiens
ccagacgacuggccagggcgccugu

SEQ ID NO: 4550 - RNA, 25 nt, Homo sapiens
agggcgccugugggaucugcaugcc

SEQ ID NO: 4551 - RNA, 25 nt, Homo sapiens
cagagugccgccuucuccacugcuc

SEQ ID NO: 4552 - RNA, 25 nt, Homo sapiens
agugccgccuucuccacugcucagg

SEQ ID NO: 4553 - RNA, 25 nt, Homo sapiens
gccgccuucuccacugcucaggcgg

SEQ ID NO: 4554 - RNA, 25 nt, Homo sapiens
ucuccacugcucaggcggaggugag

SEQ ID NO: 4555 - RNA, 25 nt, Homo sapiens
cacugcucaggcggaggugagcgga

SEQ ID NO: 4556 - RNA, 25 nt, Homo sapiens
acugcucaggcggaggugagcggaa

SEQ ID NO: 4557 - RNA, 25 nt, Homo sapiens
aggugagcggaagggaaacuguccc

SEQ ID NO: 4558 - RNA, 25 nt, Homo sapiens
agcggaagggaaacugucccagguc

SEQ ID NO: 4559 - RNA, 25 nt, Homo sapiens
gggaaacugucccaggucagguuga

SEQ ID NO: 4560 - RNA, 25 nt, Homo sapiens
ggaaacugucccaggucagguugaa

SEQ ID NO: 4561 - RNA, 25 nt, Homo sapiens
aacugucccaggucagguugaaggg

SEQ ID NO: 4562 - RNA, 25 nt, Homo sapiens
acugucccaggucagguugaaggga

SEQ ID NO: 4563 - RNA, 25 nt, Homo sapiens
ucuuagguagguggggucggcgguc

SEQ ID NO: 4564 - RNA, 25 nt, Homo sapiens
augguucuuagguagguggggucgg

SEQ ID NO: 4565 - RNA, 25 nt, Homo sapiens
aggaugguucuuagguagguggggu

SEQ ID NO: 4566 - RNA, 25 nt, Homo sapiens
ggccaggaugguucuuagguaggug

SEQ ID NO: 4567 - RNA, 25 nt, Homo sapiens
cggccaggaugguucuuagguaggu

SEQ ID NO: 4568 - RNA, 25 nt, Homo sapiens
gcggccaggaugguucuuagguagg

SEQ ID NO: 4569 - RNA, 25 nt, Homo sapiens
cuggcggccaggaugguucuuaggu

SEQ ID NO: 4570 - RNA, 25 nt, Homo sapiens
ugggcuggcggccaggaugguucuu

SEQ ID NO: 4571 - RNA, 25 nt, Homo sapiens
gcuacaacugggcuggcggccagga

SEQ ID NO: 4572 - RNA, 25 nt, Homo sapiens
cggugcuacaacugggcuggcggcc

SEQ ID NO: 4573 - RNA, 25 nt, Homo sapiens
cugggcggugcuacaacugggcugg

SEQ ID NO: 4574 - RNA, 25 nt, Homo sapiens
cgucugggcggugcuacaacugggc

SEQ ID NO: 4575 - RNA, 25 nt, Homo sapiens
cagucgucugggcggugcuacaacu

SEQ ID NO: 4576 - RNA, 25 nt, Homo sapiens
ccagucgucugggcggugcuacaac

SEQ ID NO: 4577 - RNA, 25 nt, Homo sapiens
caggcgcccuggccagucgucuggg

SEQ ID NO: 4578 - RNA, 25 nt, Homo sapiens
ccacaggcgcccuggccagucgucu

SEQ ID NO: 4579 - RNA, 25 nt, Homo sapiens
cccacaggcgcccuggccagucguc

SEQ ID NO: 4580 - RNA, 25 nt, Homo sapiens
aggcaugcagaucccacaggcgccc

SEQ ID NO: 4581 - RNA, 25 nt, Homo sapiens
gcugcuccaggcaugcagaucccac

SEQ ID NO: 4582 - RNA, 25 nt, Homo sapiens
ggcggcacucugguggggcugcucc

SEQ ID NO: 4583 - RNA, 25 nt, Homo sapiens
caguggagaaggcggcacucuggug

SEQ ID NO: 4584 - RNA, 25 nt, Homo sapiens
gcaguggagaaggcggcacucuggu

SEQ ID NO: 4585 - RNA, 25 nt, Homo sapiens
agcaguggagaaggcggcacucugg

SEQ ID NO: 4586 - RNA, 25 nt, Homo sapiens
cugagcaguggagaaggcggcacuc

SEQ ID NO: 4587 - RNA, 25 nt, Homo sapiens
accuccgccugagcaguggagaagg

SEQ ID NO: 4588 - RNA, 25 nt, Homo sapiens
cucaccuccgccugagcaguggaga

SEQ ID NO: 4589 - RNA, 25 nt, Homo sapiens
cuuccgcucaccuccgccugagcag

SEQ ID NO: 4590 - RNA, 25 nt, Homo sapiens
cgcggagcgcgcagcucacaccugg

SEQ ID NO: 4591 - RNA, 25 nt, Homo sapiens
gcgcgcagcucacaccuggcggccg

SEQ ID NO: 4592 - RNA, 25 nt, Homo sapiens
cucacaccuggcggccgcgguuucc

SEQ ID NO: 4593 - RNA, 25 nt, Homo sapiens
acaccuggcggccgcgguuuccagg

SEQ ID NO: 4594 - RNA, 25 nt, Homo sapiens
cggccgcgguuuccaggaggaagca

SEQ ID NO: 4595 - RNA, 25 nt, Homo sapiens
uuuccaggaggaagcaaggaugcuu

SEQ ID NO: 4596 - RNA, 25 nt, Homo sapiens
gcaaggaugcuuuggacacugugcg

SEQ ID NO: 4597 - RNA, 25 nt, Homo sapiens
uuggacacugugcguggcgccuccg

SEQ ID NO: 4598 - RNA, 25 nt, Homo sapiens
cgcggagcccccgcgcugccauucc

SEQ ID NO: 4599 - RNA, 25 nt, Homo sapiens
cgcgcugccauucccggccgucgcu

SEQ ID NO: 4600 - RNA, 25 nt, Homo sapiens
cggccgucgcucgguccuccgcuga

SEQ ID NO: 4601 - RNA, 25 nt, Homo sapiens
ggccgucgcucgguccuccgcugac

SEQ ID NO: 4602 - RNA, 25 nt, Homo sapiens
gcucgguccuccgcugacgggaagc

SEQ ID NO: 4603 - RNA, 25 nt, Homo sapiens
ggccggggggcagcugcacagucuc

SEQ ID NO: 4604 - RNA, 25 nt, Homo sapiens
gccggggggcagcugcacagucucc

SEQ ID NO: 4605 - RNA, 25 nt, Homo sapiens
cagcugcacagucuccgggaucccc

SEQ ID NO: 4606 - RNA, 25 nt, Homo sapiens
gcacagucuccgggauccccaggcc

SEQ ID NO: 4607 - RNA, 25 nt, Homo sapiens
cagucuccgggauccccaggccugg

SEQ ID NO: 4608 - RNA, 25 nt, Homo sapiens
agucuccgggauccccaggccugga

SEQ ID NO: 4609 - RNA, 25 nt, Homo sapiens
gucuccgggauccccaggccuggag

SEQ ID NO: 4610 - RNA, 25 nt, Homo sapiens
ucuccgggauccccaggccuggagg

SEQ ID NO: 4611 - RNA, 25 nt, Homo sapiens
cuccgggauccccaggccuggaggg

SEQ ID NO: 4612 - RNA, 25 nt, Homo sapiens
ccaggccuggaggggggucugugcg

SEQ ID NO: 4613 - RNA, 25 nt, Homo sapiens
gccuggaggggggucugugcgcggc

SEQ ID NO: 4614 - RNA, 25 nt, Homo sapiens
ggaggggggucugugcgcggccggc

SEQ ID NO: 4615 - RNA, 25 nt, Homo sapiens
cggccggcuggcucugccccgcguc

SEQ ID NO: 4616 - RNA, 25 nt, Homo sapiens
gcucugccccgcguccggucccgag

SEQ ID NO: 4617 - RNA, 25 nt, Homo sapiens
cucugccccgcguccggucccgagc

SEQ ID NO: 4618 - RNA, 25 nt, Homo sapiens
cguccggucccgagcgggccucccu

SEQ ID NO: 4619 - RNA, 25 nt, Homo sapiens
guccggucccgagcgggccucccuc

SEQ ID NO: 4620 - RNA, 25 nt, Homo sapiens
gccagcccgaugugaccgagcccag

SEQ ID NO: 4621 - RNA, 25 nt, Homo sapiens
gaccgagcccagcggagccugagca

SEQ ID NO: 4622 - RNA, 25 nt, Homo sapiens
agcccagcggagccugagcaaggag

SEQ ID NO: 4623 - RNA, 25 nt, Homo sapiens
gcccagcggagccugagcaaggagc

SEQ ID NO: 4624 - RNA, 25 nt, Homo sapiens
gccugagcaaggagcggguccgucg

SEQ ID NO: 4625 - RNA, 25 nt, Homo sapiens
gcaaggagcggguccgucgcggagc

SEQ ID NO: 4626 - RNA, 25 nt, Homo sapiens
aggagcggguccgucgcggagccgg

SEQ ID NO: 4627 - RNA, 25 nt, Homo sapiens
ggagcggguccgucgcggagccgga

SEQ ID NO: 4628 - RNA, 25 nt, Homo sapiens
gcggguccgucgcggagccggaggg

SEQ ID NO: 4629 - RNA, 25 nt, Homo sapiens
cggguccgucgcggagccggagggc

SEQ ID NO: 4630 - RNA, 25 nt, Homo sapiens
guccgucgcggagccggagggcggg

SEQ ID NO: 4631 - RNA, 25 nt, Homo sapiens
ggagggcgggaggaacaugacaucg

SEQ ID NO: 4632 - RNA, 25 nt, Homo sapiens
gggcgggaggaacaugacaucgcgg

SEQ ID NO: 4633 - RNA, 25 nt, Homo sapiens
ggaggaacaugacaucgcggaggug

SEQ ID NO: 4634 - RNA, 25 nt, Homo sapiens
gacaucgcggaggugaggagccccg

SEQ ID NO: 4635 - RNA, 25 nt, Homo sapiens
acaucgcggaggugaggagccccga

SEQ ID NO: 4636 - RNA, 25 nt, Homo sapiens
caucgcggaggugaggagccccgag

SEQ ID NO: 4637 - RNA, 25 nt, Homo sapiens
cggaggugaggagccccgaggggcc

SEQ ID NO: 4638 - RNA, 25 nt, Homo sapiens
cuuccuccuggaaaccgcggccgcc

SEQ ID NO: 4639 - RNA, 25 nt, Homo sapiens
cauccuugcuuccuccuggaaaccg

SEQ ID NO: 4640 - RNA, 25 nt, Homo sapiens
uguccaaagcauccuugcuuccucc

SEQ ID NO: 4641 - RNA, 25 nt, Homo sapiens
gaauggcagcgcgggggcuccgcgg

SEQ ID NO: 4642 - RNA, 25 nt, Homo sapiens
cgggaauggcagcgcgggggcuccg

SEQ ID NO: 4643 - RNA, 25 nt, Homo sapiens
gcgacggccgggaauggcagcgcgg

SEQ ID NO: 4644 - RNA, 25 nt, Homo sapiens
agcgacggccgggaauggcagcgcg

SEQ ID NO: 4645 - RNA, 25 nt, Homo sapiens
gagcgacggccgggaauggcagcgc

SEQ ID NO: 4646 - RNA, 25 nt, Homo sapiens
cgagcgacggccgggaauggcagcg

SEQ ID NO: 4647 - RNA, 25 nt, Homo sapiens
cggaggaccgagcgacggccgggaa

SEQ ID NO: 4648 - RNA, 25 nt, Homo sapiens
gucagcggaggaccgagcgacggcc

SEQ ID NO: 4649 - RNA, 25 nt, Homo sapiens
cgucagcggaggaccgagcgacggc

SEQ ID NO: 4650 - RNA, 25 nt, Homo sapiens
uucccgucagcggaggaccgagcga

SEQ ID NO: 4651 - RNA, 25 nt, Homo sapiens
cggacuuccugcuucccgucagcgg

SEQ ID NO: 4652 - RNA, 25 nt, Homo sapiens
cggcggacuuccugcuucccgucag

SEQ ID NO: 4653 - RNA, 25 nt, Homo sapiens
gaccccccuccaggccuggggaucc

SEQ ID NO: 4654 - RNA, 25 nt, Homo sapiens
gcgcacagaccccccuccaggccug

SEQ ID NO: 4655 - RNA, 25 nt, Homo sapiens
cgcgcacagaccccccuccaggccu

SEQ ID NO: 4656 - RNA, 25 nt, Homo sapiens
ccgcgcacagaccccccuccaggcc

SEQ ID NO: 4657 - RNA, 25 nt, Homo sapiens
gccggccgcgcacagaccccccucc

SEQ ID NO: 4658 - RNA, 25 nt, Homo sapiens
ggaccggacgcggggcagagccagc

SEQ ID NO: 4659 - RNA, 25 nt, Homo sapiens
ggaggcccgcucgggaccggacgcg

SEQ ID NO: 4660 - RNA, 25 nt, Homo sapiens
gggaggcccgcucgggaccggacgc

SEQ ID NO: 4661 - RNA, 25 nt, Homo sapiens
agggaggcccgcucgggaccggacg

SEQ ID NO: 4662 - RNA, 25 nt, Homo sapiens
ggcccgagggaggcccgcucgggac

SEQ ID NO: 4663 - RNA, 25 nt, Homo sapiens
gggcuggcccgagggaggcccgcuc

SEQ ID NO: 4664 - RNA, 25 nt, Homo sapiens
cgggcuggcccgagggaggcccgcu

SEQ ID NO: 4665 - RNA, 25 nt, Homo sapiens
cggucacaucgggcuggcccgaggg

SEQ ID NO: 4666 - RNA, 25 nt, Homo sapiens
gcucggucacaucgggcuggcccga

SEQ ID NO: 4667 - RNA, 25 nt, Homo sapiens
ggcucggucacaucgggcuggcccg

SEQ ID NO: 4668 - RNA, 25 nt, Homo sapiens
uccgcugggcucggucacaucgggc

SEQ ID NO: 4669 - RNA, 25 nt, Homo sapiens
aggcuccgcugggcucggucacauc

SEQ ID NO: 4670 - RNA, 25 nt, Homo sapiens
caggcuccgcugggcucggucacau

SEQ ID NO: 4671 - RNA, 25 nt, Homo sapiens
cuccuugcucaggcuccgcugggcu

SEQ ID NO: 4672 - RNA, 25 nt, Homo sapiens
acccgcuccuugcucaggcuccgcu

SEQ ID NO: 4673 - RNA, 25 nt, Homo sapiens
gacccgcuccuugcucaggcuccgc

SEQ ID NO: 4674 - RNA, 25 nt, Homo sapiens
uccgcgacggacccgcuccuugcuc

SEQ ID NO: 4675 - RNA, 25 nt, Homo sapiens
uuccucccgcccuccggcuccgcga

SEQ ID NO: 4676 - RNA, 25 nt, Homo sapiens
gcgaugucauguuccucccgcccuc

SEQ ID NO: 4677 - RNA, 25 nt, Homo sapiens
acuuacuuugucuuucuuuuuaaga

SEQ ID NO: 4678 - RNA, 25 nt, Homo sapiens
uaagaugguuucacccaaauaucac

SEQ ID NO: 4679 - RNA, 25 nt, Homo sapiens
ugguuucacccaaauaucacuggug

SEQ ID NO: 4680 - RNA, 25 nt, Homo sapiens
uuucacccaaauaucacuggugugg

SEQ ID NO: 4681 - RNA, 25 nt, Homo sapiens
aggcagaaaaccuacuguugacaag

SEQ ID NO: 4682 - RNA, 25 nt, Homo sapiens
accuacuguugacaagaggaguuga

SEQ ID NO: 4683 - RNA, 25 nt, Homo sapiens
acaagaggaguugauggcaguuuuu

SEQ ID NO: 4684 - RNA, 25 nt, Homo sapiens
aggaguugauggcaguuuuuuggca

SEQ ID NO: 4685 - RNA, 25 nt, Homo sapiens
uggcaaggccuaguaaaaguaaccc

SEQ ID NO: 4686 - RNA, 25 nt, Homo sapiens
cccuggagacuucacacuuuccguu

SEQ ID NO: 4687 - RNA, 25 nt, Homo sapiens
acuucacacuuuccguuagguaagu

SEQ ID NO: 4688 - RNA, 25 nt, Homo sapiens
guuagguaaguuggaaugaaaagag

SEQ ID NO: 4689 - RNA, 25 nt, Homo sapiens
uucugccuccacaccagugauauuu

SEQ ID NO: 4690 - RNA, 25 nt, Homo sapiens
uuucugccuccacaccagugauauu

SEQ ID NO: 4691 - RNA, 25 nt, Homo sapiens
gccaucaacuccucuugucaacagu

SEQ ID NO: 4692 - RNA, 25 nt, Homo sapiens
ugaagucuccaggguuacuuuuacu

SEQ ID NO: 4693 - RNA, 25 nt, Homo sapiens
ccuaacggaaagugugaagucucca

SEQ ID NO: 4694 - RNA, 25 nt, Homo sapiens
accuaacggaaagugugaagucucc

SEQ ID NO: 4695 - RNA, 25 nt, Homo sapiens
ucucuuuucauuccaacuuaccuaa

SEQ ID NO: 4696 - RNA, 25 nt, Homo sapiens
uuccaauggacuauuuuagaagaaa

SEQ ID NO: 4697 - RNA, 25 nt, Homo sapiens
ucacccacaucaagauucagaacac

SEQ ID NO: 4698 - RNA, 25 nt, Homo sapiens
acacuggugauuacuaugaccugua

SEQ ID NO: 4699 - RNA, 25 nt, Homo sapiens
cuggugauuacuaugaccuguaugg

SEQ ID NO: 4700 - RNA, 25 nt, Homo sapiens
uggugauuacuaugaccuguaugga

SEQ ID NO: 4701 - RNA, 25 nt, Homo sapiens
ggugauuacuaugaccuguauggag

SEQ ID NO: 4702 - RNA, 25 nt, Homo sapiens
uauggaggggagaaauuugccacuu

SEQ ID NO: 4703 - RNA, 25 nt, Homo sapiens
gagaaauuugccacuuuggcugagu

SEQ ID NO: 4704 - RNA, 25 nt, Homo sapiens
uuggcugaguugguccaguauuaca

SEQ ID NO: 4705 - RNA, 25 nt, Homo sapiens
ugguccaguauuacauggaacauca

SEQ ID NO: 4706 - RNA, 25 nt, Homo sapiens
gguccaguauuacauggaacaucac

SEQ ID NO: 4707 - RNA, 25 nt, Homo sapiens
aucacgggcaauuaaaagagaagaa

SEQ ID NO: 4708 - RNA, 25 nt, Homo sapiens
gaacugugcagauccuaccucugaa

SEQ ID NO: 4709 - RNA, 25 nt, Homo sapiens
uucuucuaaaauaguccauuggaaa

SEQ ID NO: 4710 - RNA, 25 nt, Homo sapiens
uuucuucuaaaauaguccauuggaa

SEQ ID NO: 4711 - RNA, 25 nt, Homo sapiens
cuccauuucuucuaaaauaguccau

SEQ ID NO: 4712 - RNA, 25 nt, Homo sapiens
ucaccaguguucugaaucuugaugu

SEQ ID NO: 4713 - RNA, 25 nt, Homo sapiens
aucaccaguguucugaaucuugaug

SEQ ID NO: 4714 - RNA, 25 nt, Homo sapiens
aguggcaaauuucuccccuccauac

SEQ ID NO: 4715 - RNA, 25 nt, Homo sapiens
uaauacuggaccaacucagccaaag

SEQ ID NO: 4716 - RNA, 25 nt, Homo sapiens
uugcccgugauguuccauguaauac

SEQ ID NO: 4717 - RNA, 25 nt, Homo sapiens
cagagguaggaucugcacaguucag

SEQ ID NO: 4718 - RNA, 25 nt, Homo sapiens
aaaauguuacugaccuuucagaggu

SEQ ID NO: 4719 - RNA, 25 nt, Homo sapiens
cacuaaaauguuacugaccuuucag

SEQ ID NO: 4720 - RNA, 25 nt, Homo sapiens
uuuuuuauuuuuuaaaaacuuuagg

SEQ ID NO: 4721 - RNA, 25 nt, Homo sapiens
uuuuuaaaaacuuuaggugguuuca

SEQ ID NO: 4722 - RNA, 25 nt, Homo sapiens
uuaggugguuucauggacaucucuc

SEQ ID NO: 4723 - RNA, 25 nt, Homo sapiens
uaggugguuucauggacaucucucu

SEQ ID NO: 4724 - RNA, 25 nt, Homo sapiens
aagcagagaaauuauuaacugaaaa

SEQ ID NO: 4725 - RNA, 25 nt, Homo sapiens
aauuauuaacugaaaaaggaaaaca

SEQ ID NO: 4726 - RNA, 25 nt, Homo sapiens
uuguacgagagagccagagccaccc

SEQ ID NO: 4727 - RNA, 25 nt, Homo sapiens
gagauuuuguucuuucugugcgcac

SEQ ID NO: 4728 - RNA, 25 nt, Homo sapiens
uuucugugcgcacuggugaugacaa

SEQ ID NO: 4729 - RNA, 25 nt, Homo sapiens
uucugugcgcacuggugaugacaaa

SEQ ID NO: 4730 - RNA, 25 nt, Homo sapiens
ucugugcgcacuggugaugacaaag

SEQ ID NO: 4731 - RNA, 25 nt, Homo sapiens
gugaugacaaaggggagagcaauga

SEQ ID NO: 4732 - RNA, 25 nt, Homo sapiens
gugacccauguuaugauucgcuguc

SEQ ID NO: 4733 - RNA, 25 nt, Homo sapiens
gucagguaaaucuccaguugaaaaa

SEQ ID NO: 4734 - RNA, 25 nt, Homo sapiens
ucagguaaaucuccaguugaaaaau

SEQ ID NO: 4735 - RNA, 25 nt, Homo sapiens
aagaacaaaaucuccaggguggcuc

SEQ ID NO: 4736 - RNA, 25 nt, Homo sapiens
cacagaaagaacaaaaucuccaggg

SEQ ID NO: 4737 - RNA, 25 nt, Homo sapiens
gcgcacagaaagaacaaaaucucca

SEQ ID NO: 4738 - RNA, 25 nt, Homo sapiens
ugcgcacagaaagaacaaaaucucc

SEQ ID NO: 4739 - RNA, 25 nt, Homo sapiens
uuuaccugacagcgaaucauaacau

SEQ ID NO: 4740 - RNA, 25 nt, Homo sapiens
auuuaccugacagcgaaucauaaca

SEQ ID NO: 4741 - RNA, 25 nt, Homo sapiens
cuugaaaggaacugaaauacgacgu

SEQ ID NO: 4742 - RNA, 25 nt, Homo sapiens
gaaaggaacugaaauacgacguugg

SEQ ID NO: 4743 - RNA, 25 nt, Homo sapiens
aggaacugaaauacgacguuggugg

SEQ ID NO: 4744 - RNA, 25 nt, Homo sapiens
gaaauacgacguugguggaggagaa

SEQ ID NO: 4745 - RNA, 25 nt, Homo sapiens
cgguuugauucuuugacagaucuug

SEQ ID NO: 4746 - RNA, 25 nt, Homo sapiens
guggaacauuauaagaagaauccua

SEQ ID NO: 4747 - RNA, 25 nt, Homo sapiens
gaacauuauaagaagaauccuaugg

SEQ ID NO: 4748 - RNA, 25 nt, Homo sapiens
aagaagaauccuaugguggaaacau

SEQ ID NO: 4749 - RNA, 25 nt, Homo sapiens
agaagaauccuaugguggaaacauu

SEQ ID NO: 4750 - RNA, 25 nt, Homo sapiens
uuggguacaguacuacaacucaagc

SEQ ID NO: 4751 - RNA, 25 nt, Homo sapiens
cuacaacucaagcaggugagcagau

SEQ ID NO: 4752 - RNA, 25 nt, Homo sapiens
guacuguacccaauguuuccaccau

SEQ ID NO: 4753 - RNA, 25 nt, Homo sapiens
cugagaccacagauaaagucaaaca

SEQ ID NO: 4754 - RNA, 25 nt, Homo sapiens
cacagauaaagucaaacaaggcuuu

SEQ ID NO: 4755 - RNA, 25 nt, Homo sapiens
acagauaaagucaaacaaggcuuuu

SEQ ID NO: 4756 - RNA, 25 nt, Homo sapiens
aaacaaggcuuuugggaagaauuug

SEQ ID NO: 4757 - RNA, 25 nt, Homo sapiens
cagcauuuauacgagucguguuaag

SEQ ID NO: 4758 - RNA, 25 nt, Homo sapiens
gcagcauuuauacgagucguguuaa

SEQ ID NO: 4759 - RNA, 25 nt, Homo sapiens
agcagcauuuauacgagucguguua

SEQ ID NO: 4760 - RNA, 25 nt, Homo sapiens
caaaagccuuguuugacuuuaucug

SEQ ID NO: 4761 - RNA, 25 nt, Homo sapiens
cuuucuuuccagacacuacaacaac

SEQ ID NO: 4762 - RNA, 25 nt, Homo sapiens
ugcaaacuucucuacagccgaaaag

SEQ ID NO: 4763 - RNA, 25 nt, Homo sapiens
gcaaacuucucuacagccgaaaaga

SEQ ID NO: 4764 - RNA, 25 nt, Homo sapiens
ucucuacagccgaaaagagggucaa

SEQ ID NO: 4765 - RNA, 25 nt, Homo sapiens
uuugcacuccuguuguuguaguguc

SEQ ID NO: 4766 - RNA, 25 nt, Homo sapiens
guuuucuugccuuugacccucuuuu

SEQ ID NO: 4767 - RNA, 25 nt, Homo sapiens
agcggaauauugauacuuacagggc

SEQ ID NO: 4768 - RNA, 25 nt, Homo sapiens
acugagcggaauauugauacuuaca

SEQ ID NO: 4769 - RNA, 25 nt, Homo sapiens
uacugagcggaauauugauacuuac

SEQ ID NO: 4770 - RNA, 25 nt, Homo sapiens
ucuuuuucuucuaguugaucauacc

SEQ ID NO: 4771 - RNA, 25 nt, Homo sapiens
cuuuuucuucuaguugaucauacca

SEQ ID NO: 4772 - RNA, 25 nt, Homo sapiens
aucauaccaggguuguccuacacga

SEQ ID NO: 4773 - RNA, 25 nt, Homo sapiens
gauuacaucaaugcaaauaucauca

SEQ ID NO: 4774 - RNA, 25 nt, Homo sapiens
gaucaacuagaagaaaaagagacca

SEQ ID NO: 4775 - RNA, 25 nt, Homo sapiens
ggaucaccaucguguaggacaaccc

SEQ ID NO: 4776 - RNA, 25 nt, Homo sapiens
aggcucauugggaucaccaucgugu

SEQ ID NO: 4777 - RNA, 25 nt, Homo sapiens
ugauguaaucugaaacaggcucauu

SEQ ID NO: 4778 - RNA, 25 nt, Homo sapiens
uugauguaaucugaaacaggcucau

SEQ ID NO: 4779 - RNA, 25 nt, Homo sapiens
uauuugcauugauguaaucugaaac

SEQ ID NO: 4780 - RNA, 25 nt, Homo sapiens
ccaaaaagaguuacauugccacaca

SEQ ID NO: 4781 - RNA, 25 nt, Homo sapiens
gccacacaaggcugccugcaaaaca

SEQ ID NO: 4782 - RNA, 25 nt, Homo sapiens
ccugcaaaacacggugaaugacuuu

SEQ ID NO: 4783 - RNA, 25 nt, Homo sapiens
gcaaaacacggugaaugacuuuugg

SEQ ID NO: 4784 - RNA, 25 nt, Homo sapiens
aacacggugaaugacuuuuggcgga

SEQ ID NO: 4785 - RNA, 25 nt, Homo sapiens
gugauugucaugacaacgaaagaag

SEQ ID NO: 4786 - RNA, 25 nt, Homo sapiens
ucaugacaacgaaagaaguggagag

SEQ ID NO: 4787 - RNA, 25 nt, Homo sapiens
acaacgaaagaaguggagagaggaa

SEQ ID NO: 4788 - RNA, 25 nt, Homo sapiens
gguuucaaauucaggcuagaaauuu

SEQ ID NO: 4789 - RNA, 25 nt, Homo sapiens
aauuguugcacuugguuucaaauuc

SEQ ID NO: 4790 - RNA, 25 nt, Homo sapiens
uuuuugggcuuugaauuguugcacu

SEQ ID NO: 4791 - RNA, 25 nt, Homo sapiens
cuuguguggcaauguaacucuuuuu

SEQ ID NO: 4792 - RNA, 25 nt, Homo sapiens
ccuuguguggcaauguaacucuuuu

SEQ ID NO: 4793 - RNA, 25 nt, Homo sapiens
accguguuuugcaggcagccuugug

SEQ ID NO: 4794 - RNA, 25 nt, Homo sapiens
ccaaaagucauucaccguguuuugc

SEQ ID NO: 4795 - RNA, 25 nt, Homo sapiens
caugacaaucacucgggaguuuucu

SEQ ID NO: 4796 - RNA, 25 nt, Homo sapiens
ucuuucguugucaugacaaucacuc

SEQ ID NO: 4797 - RNA, 25 nt, Homo sapiens
uucuuucguugucaugacaaucacu

SEQ ID NO: 4798 - RNA, 25 nt, Homo sapiens
cuuccagaguaaaugugucaaauac

SEQ ID NO: 4799 - RNA, 25 nt, Homo sapiens
cugaugaguaugcucuaaaagaaua

SEQ ID NO: 4800 - RNA, 25 nt, Homo sapiens
aaaagaauauggcgucaugcguguu

SEQ ID NO: 4801 - RNA, 25 nt, Homo sapiens
acgcuaagagaacuuaaacuuucaa

SEQ ID NO: 4802 - RNA, 25 nt, Homo sapiens
uaagagaacuuaaacuuucaaaggu

SEQ ID NO: 4803 - RNA, 25 nt, Homo sapiens
aggccaguauuugacacauuuacuc

SEQ ID NO: 4804 - RNA, 25 nt, Homo sapiens
cauauucuuuuagagcauacucauc

SEQ ID NO: 4805 - RNA, 25 nt, Homo sapiens
aguucucuuagcguauagucaugag

SEQ ID NO: 4806 - RNA, 25 nt, Homo sapiens
cugguuuuucuuggcucuacuccag

SEQ ID NO: 4807 - RNA, 25 nt, Homo sapiens
uucuuggcucuacuccaggggaaua

SEQ ID NO: 4808 - RNA, 25 nt, Homo sapiens
cuacuccaggggaauacggagagaa

SEQ ID NO: 4809 - RNA, 25 nt, Homo sapiens
ccaggggaauacggagagaacgguc

SEQ ID NO: 4810 - RNA, 25 nt, Homo sapiens
gagaacggucuggcaauaccacuuu

SEQ ID NO: 4811 - RNA, 25 nt, Homo sapiens
ggucuggcaauaccacuuucggacc

SEQ ID NO: 4812 - RNA, 25 nt, Homo sapiens
uggcaauaccacuuucggaccuggc

SEQ ID NO: 4813 - RNA, 25 nt, Homo sapiens
accacuuucggaccuggccggacca

SEQ ID NO: 4814 - RNA, 25 nt, Homo sapiens
cggaccacggcgugcccagcgaccc

SEQ ID NO: 4815 - RNA, 25 nt, Homo sapiens
ggaccacggcgugcccagcgacccu

SEQ ID NO: 4816 - RNA, 25 nt, Homo sapiens
gaccacggcgugcccagcgacccug

SEQ ID NO: 4817 - RNA, 25 nt, Homo sapiens
accacggcgugcccagcgacccugg

SEQ ID NO: 4818 - RNA, 25 nt, Homo sapiens
gugcccagcgacccugggggcgugc

SEQ ID NO: 4819 - RNA, 25 nt, Homo sapiens
gacccugggggcgugcuggacuucc

SEQ ID NO: 4820 - RNA, 25 nt, Homo sapiens
ccugggggcgugcuggacuuccugg

SEQ ID NO: 4821 - RNA, 25 nt, Homo sapiens
gggggcgugcuggacuuccuggagg

SEQ ID NO: 4822 - RNA, 25 nt, Homo sapiens
uuccuggaggaggugcaccauaagc

SEQ ID NO: 4823 - RNA, 25 nt, Homo sapiens
gugcaccauaagcaggagagcauca

SEQ ID NO: 4824 - RNA, 25 nt, Homo sapiens
auaagcaggagagcaucauggaugc

SEQ ID NO: 4825 - RNA, 25 nt, Homo sapiens
uaagcaggagagcaucauggaugca

SEQ ID NO: 4826 - RNA, 25 nt, Homo sapiens
caggagagcaucauggaugcagggc

SEQ ID NO: 4827 - RNA, 25 nt, Homo sapiens
agcaucauggaugcagggccggucg

SEQ ID NO: 4828 - RNA, 25 nt, Homo sapiens
ugcagggccggucguggugcacugc

SEQ ID NO: 4829 - RNA, 25 nt, Homo sapiens
aggugacagcuccugcugccccucu

SEQ ID NO: 4830 - RNA, 25 nt, Homo sapiens
agccugucccugucuccuagcgccc

SEQ ID NO: 4831 - RNA, 25 nt, Homo sapiens
gccugucccugucuccuagcgccca

SEQ ID NO: 4832 - RNA, 25 nt, Homo sapiens
uacccacuccuagcucuuuaacugu

SEQ ID NO: 4833 - RNA, 25 nt, Homo sapiens
guaggaagaauuuaauaucuguuug

SEQ ID NO: 4834 - RNA, 25 nt, Homo sapiens
uuugaggcauagagcaacugcauug

SEQ ID NO: 4835 - RNA, 25 nt, Homo sapiens
uugaggcauagagcaacugcauuga

SEQ ID NO: 4836 - RNA, 25 nt, Homo sapiens
ugcauugagggacauuuugauccca

SEQ ID NO: 4837 - RNA, 25 nt, Homo sapiens
cuccuagacccuacagcacugccau

SEQ ID NO: 4838 - RNA, 25 nt, Homo sapiens
gacccuacagcacugccauuggcca

SEQ ID NO: 4839 - RNA, 25 nt, Homo sapiens
acagcacugccauuggccauggcca

SEQ ID NO: 4840 - RNA, 25 nt, Homo sapiens
aguugugcauuaaacaacuucaucc

SEQ ID NO: 4841 - RNA, 25 nt, Homo sapiens
ccagaccguucucuccguauucccc

SEQ ID NO: 4842 - RNA, 25 nt, Homo sapiens
gccgugguccggccagguccgaaag

SEQ ID NO: 4843 - RNA, 25 nt, Homo sapiens
ucgcugggcacgccgugguccggcc

SEQ ID NO: 4844 - RNA, 25 nt, Homo sapiens
cagggucgcugggcacgccgugguc

SEQ ID NO: 4845 - RNA, 25 nt, Homo sapiens
gcccccagggucgcugggcacgccg

SEQ ID NO: 4846 - RNA, 25 nt, Homo sapiens
aguccagcacgcccccagggucgcu

SEQ ID NO: 4847 - RNA, 25 nt, Homo sapiens
aaguccagcacgcccccagggucgc

SEQ ID NO: 4848 - RNA, 25 nt, Homo sapiens
cuccaggaaguccagcacgccccca

SEQ ID NO: 4849 - RNA, 25 nt, Homo sapiens
ccuccaggaaguccagcacgccccc

SEQ ID NO: 4850 - RNA, 25 nt, Homo sapiens
cuccugcuuauggugcaccuccucc

SEQ ID NO: 4851 - RNA, 25 nt, Homo sapiens
ugcauccaugaugcucuccugcuua

SEQ ID NO: 4852 - RNA, 25 nt, Homo sapiens
gcugucaccugcagugcaccacgac

SEQ ID NO: 4853 - RNA, 25 nt, Homo sapiens
acaggcuguggccuagaggggcagc

SEQ ID NO: 4854 - RNA, 25 nt, Homo sapiens
gacagggacaggcuguggccuagag

SEQ ID NO: 4855 - RNA, 25 nt, Homo sapiens
agacagggacaggcuguggccuaga

SEQ ID NO: 4856 - RNA, 25 nt, Homo sapiens
gagacagggacaggcuguggccuag

SEQ ID NO: 4857 - RNA, 25 nt, Homo sapiens
ggcgcuaggagacagggacaggcug

SEQ ID NO: 4858 - RNA, 25 nt, Homo sapiens
gcccugggcgcuaggagacagggac

SEQ ID NO: 4859 - RNA, 25 nt, Homo sapiens
agcaagcccugggcgcuaggagaca

SEQ ID NO: 4860 - RNA, 25 nt, Homo sapiens
aagcaagcccugggcgcuaggagac

SEQ ID NO: 4861 - RNA, 25 nt, Homo sapiens
uagguaaaagcaagcccugggcgcu

SEQ ID NO: 4862 - RNA, 25 nt, Homo sapiens
gaguggguagguaaaagcaagcccu

SEQ ID NO: 4863 - RNA, 25 nt, Homo sapiens
ggaguggguagguaaaagcaagccc

SEQ ID NO: 4864 - RNA, 25 nt, Homo sapiens
uacaguuaaagagcuaggagugggu

SEQ ID NO: 4865 - RNA, 25 nt, Homo sapiens
uuccuacaguuaaagagcuaggagu

SEQ ID NO: 4866 - RNA, 25 nt, Homo sapiens
cuuccuacaguuaaagagcuaggag

SEQ ID NO: 4867 - RNA, 25 nt, Homo sapiens
aaauucuuccuacaguuaaagagcu

SEQ ID NO: 4868 - RNA, 25 nt, Homo sapiens
guagggucuaggagaaauaugccuu

SEQ ID NO: 4869 - RNA, 25 nt, Homo sapiens
uguagggucuaggagaaauaugccu

SEQ ID NO: 4870 - RNA, 25 nt, Homo sapiens
ggccaauggcagugcuguagggucu

SEQ ID NO: 4871 - RNA, 25 nt, Homo sapiens
ggccauggccaauggcagugcugua

SEQ ID NO: 4872 - RNA, 25 nt, Homo sapiens
uggccauggccaauggcagugcugu

SEQ ID NO: 4873 - RNA, 25 nt, Homo sapiens
agcauguugccauggccauggccaa

SEQ ID NO: 4874 - RNA, 25 nt, Homo sapiens
uuaacugagcauguugccauggcca

SEQ ID NO: 4875 - RNA, 25 nt, Homo sapiens
gcuguuuuaacugagcauguugcca

SEQ ID NO: 4876 - RNA, 25 nt, Homo sapiens
aaguuguuuaaugcacaacuucugg

SEQ ID NO: 4877 - RNA, 25 nt, Homo sapiens
augaaguuguuuaaugcacaacuuc

SEQ ID NO: 4878 - RNA, 25 nt, Homo sapiens
aagaauaaggagaaacugcagagcc

SEQ ID NO: 4879 - RNA, 25 nt, Homo sapiens
cuuuuuguccuucugcccgcagugc

SEQ ID NO: 4880 - RNA, 25 nt, Homo sapiens
guccuucugcccgcagugcuggaau

SEQ ID NO: 4881 - RNA, 25 nt, Homo sapiens
uucugcccgcagugcuggaauuggc

SEQ ID NO: 4882 - RNA, 25 nt, Homo sapiens
cccgcagugcuggaauuggccggac

SEQ ID NO: 4883 - RNA, 25 nt, Homo sapiens
ccgcagugcuggaauuggccggaca

SEQ ID NO: 4884 - RNA, 25 nt, Homo sapiens
uucuuauugacaucaucagagagaa

SEQ ID NO: 4885 - RNA, 25 nt, Homo sapiens
uuauugacaucaucagagagaaagg

SEQ ID NO: 4886 - RNA, 25 nt, Homo sapiens
uauugacaucaucagagagaaaggu

SEQ ID NO: 4887 - RNA, 25 nt, Homo sapiens
ucaucagagagaaaggugggucauc

SEQ ID NO: 4888 - RNA, 25 nt, Homo sapiens
ucagagagaaaggugggucaucugg

SEQ ID NO: 4889 - RNA, 25 nt, Homo sapiens
cagagagaaaggugggucaucuggu

SEQ ID NO: 4890 - RNA, 25 nt, Homo sapiens
ggccaauuccagcacugcgggcaga

SEQ ID NO: 4891 - RNA, 25 nt, Homo sapiens
ccuguccggccaauuccagcacugc

SEQ ID NO: 4892 - RNA, 25 nt, Homo sapiens
cccuguccggccaauuccagcacug

SEQ ID NO: 4893 - RNA, 25 nt, Homo sapiens
aucaaucacaaugaacgucccuguc

SEQ ID NO: 4894 - RNA, 25 nt, Homo sapiens
auugacguucccaaaaccauccaga

SEQ ID NO: 4895 - RNA, 25 nt, Homo sapiens
cguucccaaaaccauccagauggug

SEQ ID NO: 4896 - RNA, 25 nt, Homo sapiens
aaccauccagauggugcggucucag

SEQ ID NO: 4897 - RNA, 25 nt, Homo sapiens
uccagauggugcggucucagagguc

SEQ ID NO: 4898 - RNA, 25 nt, Homo sapiens
ccagauggugcggucucagagguca

SEQ ID NO: 4899 - RNA, 25 nt, Homo sapiens
auggugcggucucagaggucaggga

SEQ ID NO: 4900 - RNA, 25 nt, Homo sapiens
gaagcacaguaccgauuuaucuaua

SEQ ID NO: 4901 - RNA, 25 nt, Homo sapiens
gcacaguaccgauuuaucuauaugg

SEQ ID NO: 4902 - RNA, 25 nt, Homo sapiens
gcauuauauugaaacacuacagcgc

SEQ ID NO: 4903 - RNA, 25 nt, Homo sapiens
cuacagcgcaggauugaagaagagc

SEQ ID NO: 4904 - RNA, 25 nt, Homo sapiens
uugaagaagagcagguaccagccug

SEQ ID NO: 4905 - RNA, 25 nt, Homo sapiens
ugaagaagagcagguaccagccuga

SEQ ID NO: 4906 - RNA, 25 nt, Homo sapiens
gaagagcagguaccagccugagggc

SEQ ID NO: 4907 - RNA, 25 nt, Homo sapiens
ucaauaucgcagucaacaccuacga

SEQ ID NO: 4908 - RNA, 25 nt, Homo sapiens
gagaccgcaccaucuggaugguuuu

SEQ ID NO: 4909 - RNA, 25 nt, Homo sapiens
ugagaccgcaccaucuggaugguuu

SEQ ID NO: 4910 - RNA, 25 nt, Homo sapiens
gaccucugagaccgcaccaucugga

SEQ ID NO: 4911 - RNA, 25 nt, Homo sapiens
cccugaccucugagaccgcaccauc

SEQ ID NO: 4912 - RNA, 25 nt, Homo sapiens
gauaaaucgguacugugcuucuguc

SEQ ID NO: 4913 - RNA, 25 nt, Homo sapiens
augcuggaccgccauauagauaaau

SEQ ID NO: 4914 - RNA, 25 nt, Homo sapiens
gcgcuguaguguuucaauauaaugc

SEQ ID NO: 4915 - RNA, 25 nt, Homo sapiens
cucuuccaaauuucagaaaagcaag

SEQ ID NO: 4916 - RNA, 25 nt, Homo sapiens
ccaaauuucagaaaagcaagaggaa

SEQ ID NO: 4917 - RNA, 25 nt, Homo sapiens
caaauuucagaaaagcaagaggaaa

SEQ ID NO: 4918 - RNA, 25 nt, Homo sapiens
uauacaaauauuaaguauucucuag

SEQ ID NO: 4919 - RNA, 25 nt, Homo sapiens
aguauucucuagcggaccagacgag

SEQ ID NO: 4920 - RNA, 25 nt, Homo sapiens
cccugugcagaguaaguagugcuga

SEQ ID NO: 4921 - RNA, 25 nt, Homo sapiens
ccuuuccucuugcuuuucugaaauu

SEQ ID NO: 4922 - RNA, 25 nt, Homo sapiens
gagagggcucugaucuccacucguc

SEQ ID NO: 4923 - RNA, 25 nt, Homo sapiens
uggcguuggaguacaaggcgggaga

SEQ ID NO: 4924 - RNA, 25 nt, Homo sapiens
guggcguuggaguacaaggcgggag

SEQ ID NO: 4925 - RNA, 25 nt, Homo sapiens
acaggguggcguuggaguacaaggc

SEQ ID NO: 4926 - RNA, 25 nt, Homo sapiens
cacaggguggcguuggaguacaagg

SEQ ID NO: 4927 - RNA, 25 nt, Homo sapiens
cugcacaggguggcguuggaguaca

SEQ ID NO: 4928 - RNA, 25 nt, Homo sapiens
cuacuuacucugcacaggguggcgu

SEQ ID NO: 4929 - RNA, 25 nt, Homo sapiens
ucagcacuacuuacucugcacaggg

SEQ ID NO: 4930 - RNA, 25 nt, Homo sapiens
ccuucagcacuacuuacucugcaca

SEQ ID NO: 4931 - RNA, 25 nt, Homo sapiens
uccuucagcacuacuuacucugcac

SEQ ID NO: 4932 - RNA, 25 nt, Homo sapiens
gacagugcuagagucuaugaaaacg

SEQ ID NO: 4933 - RNA, 25 nt, Homo sapiens
acagugcuagagucuaugaaaacgu

SEQ ID NO: 4934 - RNA, 25 nt, Homo sapiens
ccugccaaaacuucagcacagaaau

SEQ ID NO: 4935 - RNA, 25 nt, Homo sapiens
acucuagcacugucuucucucauuc

SEQ ID NO: 4936 - RNA, 25 nt, Homo sapiens
ucugaaacuuuucugcuguugcauc

SEQ ID NO: 4937 - RNA, 25 nt, Homo sapiens
ccuauuucugugcugaaguuuuggc

SEQ ID NO: 4938 - RNA, 25 nt, Homo sapiens
aauaccuauuucugugcugaaguuu

SEQ ID NO: 4939 - RNA, 25 nt, Homo sapiens
ucuuaacuuauuucuuccccagaug

SEQ ID NO: 4940 - RNA, 25 nt, Homo sapiens
agaaaguuuaugugaagacagaauu

SEQ ID NO: 4941 - RNA, 25 nt, Homo sapiens
uuuaugugaagacagaauuuggauu

SEQ ID NO: 4942 - RNA, 25 nt, Homo sapiens
ugugaagacagaauuuggauuugga

SEQ ID NO: 4943 - RNA, 25 nt, Homo sapiens
auuuggauuuggaaggcuugcaaug

SEQ ID NO: 4944 - RNA, 25 nt, Homo sapiens
auuuuauagaauuuguuugaaauug

SEQ ID NO: 4945 - RNA, 25 nt, Homo sapiens
auugugcgcuguauuuugcagauua

SEQ ID NO: 4946 - RNA, 25 nt, Homo sapiens
uugugcgcuguauuuugcagauuau

SEQ ID NO: 4947 - RNA, 25 nt, Homo sapiens
ugugcgcuguauuuugcagauuaug

SEQ ID NO: 4948 - RNA, 25 nt, Homo sapiens
uuauggggauucaaauucuaguaau

SEQ ID NO: 4949 - RNA, 25 nt, Homo sapiens
guuuaauuuuuuuuuuccucauugu

SEQ ID NO: 4950 - RNA, 25 nt, Homo sapiens
uuuaauuuuuuuuuuccucauuguu

SEQ ID NO: 4951 - RNA, 25 nt, Homo sapiens
uuaauuuuuuuuuuccucauuguug

SEQ ID NO: 4952 - RNA, 25 nt, Homo sapiens
uuggggaugaugagaagaaaugauu

SEQ ID NO: 4953 - RNA, 25 nt, Homo sapiens
uggggaugaugagaagaaaugauuu

SEQ ID NO: 4954 - RNA, 25 nt, Homo sapiens
ucauuuaccaucauguauccaguag

SEQ ID NO: 4955 - RNA, 25 nt, Homo sapiens
uccaguaguggauaauucauuuuga

SEQ ID NO: 4956 - RNA, 25 nt, Homo sapiens
aauucauuuugauggcuucuauuuu

SEQ ID NO: 4957 - RNA, 25 nt, Homo sapiens
gacugucagaaguugaccuuugcac

SEQ ID NO: 4958 - RNA, 25 nt, Homo sapiens
uuaaagagucauagaaaaagaauca

SEQ ID NO: 4959 - RNA, 25 nt, Homo sapiens
aagaaucauggauauuuaugaauua

SEQ ID NO: 4960 - RNA, 25 nt, Homo sapiens
auggauauuuaugaauuaagguaag

SEQ ID NO: 4961 - RNA, 25 nt, Homo sapiens
uauuuaugaauuaagguaagaggug

SEQ ID NO: 4962 - RNA, 25 nt, Homo sapiens
uuccagccguugaccaauuauaguu

SEQ ID NO: 4963 - RNA, 25 nt, Homo sapiens
guucggcuguugacugagaaguuug

SEQ ID NO: 4964 - RNA, 25 nt, Homo sapiens
cggcuguugacugagaaguuugugg

SEQ ID NO: 4965 - RNA, 25 nt, Homo sapiens
ggcuguugacugagaaguuuguggu

SEQ ID NO: 4966 - RNA, 25 nt, Homo sapiens
aauaauugucuuguacuuagaaaaa

SEQ ID NO: 4967 - RNA, 25 nt, Homo sapiens
ggcgucuaugaaugaccaguguuuu

SEQ ID NO: 4968 - RNA, 25 nt, Homo sapiens
ugguuuuuucuaaucagaagaaagc

SEQ ID NO: 4969 - RNA, 25 nt, Homo sapiens
gguuuuuucuaaucagaagaaagcu

SEQ ID NO: 4970 - RNA, 25 nt, Homo sapiens
guuuuuucuaaucagaagaaagcug

SEQ ID NO: 4971 - RNA, 25 nt, Homo sapiens
gauucaagaaaagggugugaaguag

SEQ ID NO: 4972 - RNA, 25 nt, Homo sapiens
ggugugaaguagaggugcaguuaag

SEQ ID NO: 4973 - RNA, 25 nt, Homo sapiens
gugugaaguagaggugcaguuaagu

SEQ ID NO: 4974 - RNA, 25 nt, Homo sapiens
ugugaaguagaggugcaguuaagug

SEQ ID NO: 4975 - RNA, 25 nt, Homo sapiens
gugaaguagaggugcaguuaagugg

SEQ ID NO: 4976 - RNA, 25 nt, Homo sapiens
ugaaguagaggugcaguuaaguggg

SEQ ID NO: 4977 - RNA, 25 nt, Homo sapiens
aguggggggccacuagucuaacaga

SEQ ID NO: 4978 - RNA, 25 nt, Homo sapiens
uaacagacggucacaaccagugcca

SEQ ID NO: 4979 - RNA, 25 nt, Homo sapiens
ucacaaccagugccauggaaaacca

SEQ ID NO: 4980 - RNA, 25 nt, Homo sapiens
caaaagcagaaguugcuagugaccu

SEQ ID NO: 4981 - RNA, 25 nt, Homo sapiens
aaaagcagaaguugcuagugaccuu

SEQ ID NO: 4982 - RNA, 25 nt, Homo sapiens
ggaagccgaagcugcuuacaguagc

SEQ ID NO: 4983 - RNA, 25 nt, Homo sapiens
gaagccgaagcugcuuacaguagcu

SEQ ID NO: 4984 - RNA, 25 nt, Homo sapiens
gaaagucagacuaagaaauaaagag

SEQ ID NO: 4985 - RNA, 25 nt, Homo sapiens
aaagucagacuaagaaauaaagaga

SEQ ID NO: 4986 - RNA, 25 nt, Homo sapiens
uuucugcuagcccugagccuauuuu

SEQ ID NO: 4987 - RNA, 25 nt, Homo sapiens
ugagccuauuuuuggaaccagcacu

SEQ ID NO: 4988 - RNA, 25 nt, Homo sapiens
gagccuauuuuuggaaccagcacuu

SEQ ID NO: 4989 - RNA, 25 nt, Homo sapiens
agccuauuuuuggaaccagcacuug

SEQ ID NO: 4990 - RNA, 25 nt, Homo sapiens
agcacuuggggaaacugaucuugug

SEQ ID NO: 4991 - RNA, 25 nt, Homo sapiens
cuuggggaaacugaucuugugagga

SEQ ID NO: 4992 - RNA, 25 nt, Homo sapiens
ugaucuugugaggauggauguguuu

SEQ ID NO: 4993 - RNA, 25 nt, Homo sapiens
gaucuugugaggauggauguguuua

SEQ ID NO: 4994 - RNA, 25 nt, Homo sapiens
ugaggauggauguguuuagggacac

SEQ ID NO: 4995 - RNA, 25 nt, Homo sapiens
gaggauggauguguuuagggacaca

SEQ ID NO: 4996 - RNA, 25 nt, Homo sapiens
gcuuuugagagcagcaccaccccac

SEQ ID NO: 4997 - RNA, 25 nt, Homo sapiens
cuuuugagagcagcaccaccccacu

SEQ ID NO: 4998 - RNA, 25 nt, Homo sapiens
uuuugagagcagcaccaccccacug

SEQ ID NO: 4999 - RNA, 25 nt, Homo sapiens
caccccacuggggcauccccagacu

SEQ ID NO: 5000 - RNA, 25 nt, Homo sapiens
accccacuggggcauccccagacuu

SEQ ID NO: 5001 - RNA, 25 nt, Homo sapiens
aaacgugacucuuucuuaaugccac

SEQ ID NO: 5002 - RNA, 25 nt, Homo sapiens
aacgugacucuuucuuaaugccacu

SEQ ID NO: 5003 - RNA, 25 nt, Homo sapiens
uucuuaaugccacuggguuuuaguc

SEQ ID NO: 5004 - RNA, 25 nt, Homo sapiens
ggguuuuagucaggccacagugaga

SEQ ID NO: 5005 - RNA, 25 nt, Homo sapiens
cacagugagaaggaacagcccuaac

SEQ ID NO: 5006 - RNA, 25 nt, Homo sapiens
gaacagcccuaacaggccuccagcc

SEQ ID NO: 5007 - RNA, 25 nt, Homo sapiens
gccucauauguugaaucauccagug

SEQ ID NO: 5008 - RNA, 25 nt, Homo sapiens
gcggauauuucaaugaaaauaucau

SEQ ID NO: 5009 - RNA, 25 nt, Homo sapiens
aaauaucauugguugacuuuuguga

SEQ ID NO: 5010 - RNA, 25 nt, Homo sapiens
gacuuuugugaugguaauaaugcua

SEQ ID NO: 5011 - RNA, 25 nt, Homo sapiens
cuauggcaucuuugccaugaaguug

SEQ ID NO: 5012 - RNA, 25 nt, Homo sapiens
cuuugccaugaaguuguggccuccu

SEQ ID NO: 5013 - RNA, 25 nt, Homo sapiens
uggccuccuuggauucuucugacuu

SEQ ID NO: 5014 - RNA, 25 nt, Homo sapiens
gauucuucugacuuuggcuucugaa

SEQ ID NO: 5015 - RNA, 25 nt, Homo sapiens
cuucugacuuuggcuucugaaagga

SEQ ID NO: 5016 - RNA, 25 nt, Homo sapiens
ugaaaggaaggccuagauccagccc

SEQ ID NO: 5017 - RNA, 25 nt, Homo sapiens
aaggaaggccuagauccagcccugg

SEQ ID NO: 5018 - RNA, 25 nt, Homo sapiens
cagcccuggugguaguuccuuucug

SEQ ID NO: 5019 - RNA, 25 nt, Homo sapiens
gaggucucucagucccuugagacuu

SEQ ID NO: 5020 - RNA, 25 nt, Homo sapiens
aggucucucagucccuugagacuuu

SEQ ID NO: 5021 - RNA, 25 nt, Homo sapiens
ggucucucagucccuugagacuuug

SEQ ID NO: 5022 - RNA, 25 nt, Homo sapiens
agucccuugagacuuugggguaguu

SEQ ID NO: 5023 - RNA, 25 nt, Homo sapiens
ugaacuuugaauugcuucagaacac

SEQ ID NO: 5024 - RNA, 25 nt, Homo sapiens
uuugaauugcuucagaacacaggug

SEQ ID NO: 5025 - RNA, 25 nt, Homo sapiens
gcuucagaacacagguguggccuga

SEQ ID NO: 5026 - RNA, 25 nt, Homo sapiens
uguggccugaagguauucccuuauu

SEQ ID NO: 5027 - RNA, 25 nt, Homo sapiens
guggccugaagguauucccuuauua

SEQ ID NO: 5028 - RNA, 25 nt, Homo sapiens
caucgacucauucuccauuuugcuu

SEQ ID NO: 5029 - RNA, 25 nt, Homo sapiens
guuuugucuugacuugacuugacuu

SEQ ID NO: 5030 - RNA, 25 nt, Homo sapiens
uuuugucuugacuugacuugacuuu

SEQ ID NO: 5031 - RNA, 25 nt, Homo sapiens
uuugucuugacuugacuugacuuug

SEQ ID NO: 5032 - RNA, 25 nt, Homo sapiens
uugucuugacuugacuugacuuugg

SEQ ID NO: 5033 - RNA, 25 nt, Homo sapiens
agaucaguugcuuuuauacucagaa

SEQ ID NO: 5034 - RNA, 25 nt, Homo sapiens
uacucagaauggaaauaccugaucu

SEQ ID NO: 5035 - RNA, 25 nt, Homo sapiens
gauuucauuuagauuucccuccacg

SEQ ID NO: 5036 - RNA, 25 nt, Homo sapiens
aacuaucauguucuuauguaaacuu

SEQ ID NO: 5037 - RNA, 25 nt, Homo sapiens
cauguucuuauguaaacuuaggcca

SEQ ID NO: 5038 - RNA, 25 nt, Homo sapiens
caaggccagaguuaucauagucccu

SEQ ID NO: 5039 - RNA, 25 nt, Homo sapiens
aguuaucauagucccuagguugcua

SEQ ID NO: 5040 - RNA, 25 nt, Homo sapiens
agguugcuacggcuuaucaugugcu

SEQ ID NO: 5041 - RNA, 25 nt, Homo sapiens
uacggcuuaucaugugcuugguaaa

SEQ ID NO: 5042 - RNA, 25 nt, Homo sapiens
caugugcuugguaaaaggugaucgc

SEQ ID NO: 5043 - RNA, 25 nt, Homo sapiens
ucagacgaguuuacuuuacaugaga

SEQ ID NO: 5044 - RNA, 25 nt, Homo sapiens
aguuuacuuuacaugagauggaauc

SEQ ID NO: 5045 - RNA, 25 nt, Homo sapiens
uuacaugagauggaaucaggcagag

SEQ ID NO: 5046 - RNA, 25 nt, Homo sapiens
augagauggaaucaggcagagaggc

SEQ ID NO: 5047 - RNA, 25 nt, Homo sapiens
ugagauggaaucaggcagagaggcu

SEQ ID NO: 5048 - RNA, 25 nt, Homo sapiens
gaaucaggcagagaggcugggauga

SEQ ID NO: 5049 - RNA, 25 nt, Homo sapiens
aggcugggaugauggagaaagcucg

SEQ ID NO: 5050 - RNA, 25 nt, Homo sapiens
aggugaaguuuuaaaaaaaaaguug

SEQ ID NO: 5051 - RNA, 25 nt, Homo sapiens
aaguuuuaaaaaaaaaguuguggaa

SEQ ID NO: 5052 - RNA, 25 nt, Homo sapiens
aguuguggaaaggaaaguuccaaag

SEQ ID NO: 5053 - RNA, 25 nt, Homo sapiens
uguggaaaggaaaguuccaaagagg

SEQ ID NO: 5054 - RNA, 25 nt, Homo sapiens
gaaaguuccaaagaggugguuucug

SEQ ID NO: 5055 - RNA, 25 nt, Homo sapiens
gguuucugaggaagucagagcgccc

SEQ ID NO: 5056 - RNA, 25 nt, Homo sapiens
guuucugaggaagucagagcgccca

SEQ ID NO: 5057 - RNA, 25 nt, Homo sapiens
cgcccagggccagagcagucaguaa

SEQ ID NO: 5058 - RNA, 25 nt, Homo sapiens
gcccagggccagagcagucaguaau

SEQ ID NO: 5059 - RNA, 25 nt, Homo sapiens
cagagcagucaguaaugggugaaug

SEQ ID NO: 5060 - RNA, 25 nt, Homo sapiens
ucaguaaugggugaaugagguuguu

SEQ ID NO: 5061 - RNA, 25 nt, Homo sapiens
gggugaaugagguuguuuggaaagu

SEQ ID NO: 5062 - RNA, 25 nt, Homo sapiens
uuggaaagucggugugacagacaca

SEQ ID NO: 5063 - RNA, 25 nt, Homo sapiens
agacacauggaugccaucuacuucu

SEQ ID NO: 5064 - RNA, 25 nt, Homo sapiens
uggaugccaucuacuucuagguugc

SEQ ID NO: 5065 - RNA, 25 nt, Homo sapiens
augccaucuacuucuagguugcugg

SEQ ID NO: 5066 - RNA, 25 nt, Homo sapiens
ugccaucuacuucuagguugcuggu

SEQ ID NO: 5067 - RNA, 25 nt, Homo sapiens
augcacaauauuccauagcucacug

SEQ ID NO: 5068 - RNA, 25 nt, Homo sapiens
cugaggauuuuaaaauuauaagcau

SEQ ID NO: 5069 - RNA, 25 nt, Homo sapiens
auuauaagcauaggauuuuauauuu

SEQ ID NO: 5070 - RNA, 25 nt, Homo sapiens
uuauaagcauaggauuuuauauuuu

SEQ ID NO: 5071 - RNA, 25 nt, Homo sapiens
uauaagcauaggauuuuauauuuug

SEQ ID NO: 5072 - RNA, 25 nt, Homo sapiens
uauauuuuggggugaaagaauuauc

SEQ ID NO: 5073 - RNA, 25 nt, Homo sapiens
gggugaaagaauuaucuggcacauu

SEQ ID NO: 5074 - RNA, 25 nt, Homo sapiens
aagaauuaucuggcacauuagguau

SEQ ID NO: 5075 - RNA, 25 nt, Homo sapiens
auaacuuuuuuuaaaaaaaacuaaa

SEQ ID NO: 5076 - RNA, 25 nt, Homo sapiens
uaaaaggcgcuucauguccagugug

SEQ ID NO: 5077 - RNA, 25 nt, Homo sapiens
caguguguggcccuucugaaacuua

SEQ ID NO: 5078 - RNA, 25 nt, Homo sapiens
auggucaucucucccacugaaacca

SEQ ID NO: 5079 - RNA, 25 nt, Homo sapiens
acugaaaccaaggucuuuucaaaug

SEQ ID NO: 5080 - RNA, 25 nt, Homo sapiens
caaggucuuuucaaauguggcuaaa

SEQ ID NO: 5081 - RNA, 25 nt, Homo sapiens
aaggucuuuucaaauguggcuaaau

SEQ ID NO: 5082 - RNA, 25 nt, Homo sapiens
aggucuuuucaaauguggcuaaaug

SEQ ID NO: 5083 - RNA, 25 nt, Homo sapiens
uuucaaauguggcuaaauggggaug

SEQ ID NO: 5084 - RNA, 25 nt, Homo sapiens
guggcuaaauggggaugaggagaca

SEQ ID NO: 5085 - RNA, 25 nt, Homo sapiens
uggcuaaauggggaugaggagacac

SEQ ID NO: 5086 - RNA, 25 nt, Homo sapiens
uaaauggggaugaggagacacgggu

SEQ ID NO: 5087 - RNA, 25 nt, Homo sapiens
ugaggagacacggguaggacuuucu

SEQ ID NO: 5088 - RNA, 25 nt, Homo sapiens
cauucuuuaaagagccaaguugcuu

SEQ ID NO: 5089 - RNA, 25 nt, Homo sapiens
auucuuuaaagagccaaguugcuuc

SEQ ID NO: 5090 - RNA, 25 nt, Homo sapiens
uucuuuaaagagccaaguugcuucg

SEQ ID NO: 5091 - RNA, 25 nt, Homo sapiens
gccaaguugcuucggggaaacagcc

SEQ ID NO: 5092 - RNA, 25 nt, Homo sapiens
ugcuucggggaaacagccaggaaaa

SEQ ID NO: 5093 - RNA, 25 nt, Homo sapiens
ggaaaauggucaagauuauuuuuag

SEQ ID NO: 5094 - RNA, 25 nt, Homo sapiens
agauuauuuuuagagguuauuuuau

SEQ ID NO: 5095 - RNA, 25 nt, Homo sapiens
gauuauuuuuagagguuauuuuauu

SEQ ID NO: 5096 - RNA, 25 nt, Homo sapiens
auuauuuuuagagguuauuuuauug

SEQ ID NO: 5097 - RNA, 25 nt, Homo sapiens
uaacaucuugaguuauuuuuaauuc

SEQ ID NO: 5098 - RNA, 25 nt, Homo sapiens
aacaucuugaguuauuuuuaauuca

SEQ ID NO: 5099 - RNA, 25 nt, Homo sapiens
acaucuugaguuauuuuuaauucag

SEQ ID NO: 5100 - RNA, 25 nt, Homo sapiens
caucuugaguuauuuuuaauucagg

SEQ ID NO: 5101 - RNA, 25 nt, Homo sapiens
gaguuauuuuuaauucagggggaug

SEQ ID NO: 5102 - RNA, 25 nt, Homo sapiens
auuuuuaauucagggggauguggaa

SEQ ID NO: 5103 - RNA, 25 nt, Homo sapiens
guuuuguuguagcuuaguauccaua

SEQ ID NO: 5104 - RNA, 25 nt, Homo sapiens
uuuuguuguagcuuaguauccauaa

SEQ ID NO: 5105 - RNA, 25 nt, Homo sapiens
gcagcuuuuguuuucuguauguugu

SEQ ID NO: 5106 - RNA, 25 nt, Homo sapiens
cagcuuuuguuuucuguauguuguu

SEQ ID NO: 5107 - RNA, 25 nt, Homo sapiens
agcuuuuguuuucuguauguuguug

SEQ ID NO: 5108 - RNA, 25 nt, Homo sapiens
gcuuuuguuuucuguauguuguugg

SEQ ID NO: 5109 - RNA, 25 nt, Homo sapiens
ucaacuuucacacauagcaagcaca

SEQ ID NO: 5110 - RNA, 25 nt, Homo sapiens
gcaagcacauggccucccugauguc

SEQ ID NO: 5111 - RNA, 25 nt, Homo sapiens
ucccugaugucaggaugccuuuguu

SEQ ID NO: 5112 - RNA, 25 nt, Homo sapiens
cuaaaaauuuguuccuuuuucacua

SEQ ID NO: 5113 - RNA, 25 nt, Homo sapiens
uaaaaauuuguuccuuuuucacuau

SEQ ID NO: 5114 - RNA, 25 nt, Homo sapiens
uuuuucacuaugggcaguucacaca

SEQ ID NO: 5115 - RNA, 25 nt, Homo sapiens
cacaaggcaaaaacuauugaacagu

SEQ ID NO: 5116 - RNA, 25 nt, Homo sapiens
ugauucuuuuauuaauaaaagcuaa

SEQ ID NO: 5117 - RNA, 25 nt, Homo sapiens
gauucuuuuauuaauaaaagcuaau

SEQ ID NO: 5118 - RNA, 25 nt, Homo sapiens
uuuauuaauaaaagcuaaugggaaa

SEQ ID NO: 5119 - RNA, 25 nt, Homo sapiens
uuuauugauaaaucuauccuuuaaa

SEQ ID NO: 5120 - RNA, 25 nt, Homo sapiens
cuauccuuuaaaaggaauacguuuu

SEQ ID NO: 5121 - RNA, 25 nt, Homo sapiens
aauaguuuauguagagaaacauuag

SEQ ID NO: 5122 - RNA, 25 nt, Homo sapiens
uuaauugucuccccaccuauauuua

SEQ ID NO: 5123 - RNA, 25 nt, Homo sapiens
uaauugucuccccaccuauauuuau

SEQ ID NO: 5124 - RNA, 25 nt, Homo sapiens
aguaaaaguguauuuguaaacugua

SEQ ID NO: 5125 - RNA, 25 nt, Homo sapiens
guaaaaguguauuuguaaacuguau

SEQ ID NO: 5126 - RNA, 25 nt, Homo sapiens
guaaacuguaugggaacuaaaaauu

SEQ ID NO: 5127 - RNA, 25 nt, Homo sapiens
ggaauaaaaccauuuucuuauauga

SEQ ID NO: 5128 - RNA, 25 nt, Homo sapiens
gggagagggugaaaguccacaucug

SEQ ID NO: 5129 - RNA, 25 nt, Homo sapiens
agggagagggugaaaguccacaucu

SEQ ID NO: 5130 - RNA, 25 nt, Homo sapiens
uagggagagggugaaaguccacauc

SEQ ID NO: 5131 - RNA, 25 nt, Homo sapiens
ucuguucuugaucuuuuuagggaga

SEQ ID NO: 5132 - RNA, 25 nt, Homo sapiens
gucuguucuugaucuuuuuagggag

SEQ ID NO: 5133 - RNA, 25 nt, Homo sapiens
cuugcgucuguucuugaucuuuuua

SEQ ID NO: 5134 - RNA, 25 nt, Homo sapiens
ucuugcgucuguucuugaucuuuuu

SEQ ID NO: 5135 - RNA, 25 nt, Homo sapiens
augguuucaaauuuugcuuaucaaa

SEQ ID NO: 5136 - RNA, 25 nt, Homo sapiens
gaguuaaaauacaguggucuuuaaa

SEQ ID NO: 5137 - RNA, 25 nt, Homo sapiens
cagguauuguugaguuaaaauacag

SEQ ID NO: 5138 - RNA, 25 nt, Homo sapiens
cugaggaaaugaguaauugggaagc

SEQ ID NO: 5139 - RNA, 25 nt, Homo sapiens
uucuuaucugaggaaaugaguaauu

SEQ ID NO: 5140 - RNA, 25 nt, Homo sapiens
cuucuuaucugaggaaaugaguaau

SEQ ID NO: 5141 - RNA, 25 nt, Homo sapiens
uguagagaugauuucuucuuaucug

SEQ ID NO: 5142 - RNA, 25 nt, Homo sapiens
ggaaaaaaaaaauuaaacugguuaa

SEQ ID NO: 5143 - RNA, 25 nt, Homo sapiens
aggaaaaaaaaaauuaaacugguua

SEQ ID NO: 5144 - RNA, 25 nt, Homo sapiens
acaaugaggaaaaaaaaaauuaaac

SEQ ID NO: 5145 - RNA, 25 nt, Homo sapiens
uuucuucucaucauccccaacaaug

SEQ ID NO: 5146 - RNA, 25 nt, Homo sapiens
uaaaugagauuguucucacuuuucu

SEQ ID NO: 5147 - RNA, 25 nt, Homo sapiens
gaauuauccacuacuggauacauga

SEQ ID NO: 5148 - RNA, 25 nt, Homo sapiens
gccaucaaaaugaauuauccacuac

SEQ ID NO: 5149 - RNA, 25 nt, Homo sapiens
cucaggcacuggcuuaauucucauu

SEQ ID NO: 5150 - RNA, 25 nt, Homo sapiens
gucaacuucugacagucucaggcac

SEQ ID NO: 5151 - RNA, 25 nt, Homo sapiens
gcaaaggucaacuucugacagucuc

SEQ ID NO: 5152 - RNA, 25 nt, Homo sapiens
cuaugacucuuuaaugccagugcaa

SEQ ID NO: 5153 - RNA, 25 nt, Homo sapiens
agccgaacuauaauuggucaacggc

SEQ ID NO: 5154 - RNA, 25 nt, Homo sapiens
caacagccgaacuauaauuggucaa

SEQ ID NO: 5155 - RNA, 25 nt, Homo sapiens
ucucagucaacagccgaacuauaau

SEQ ID NO: 5156 - RNA, 25 nt, Homo sapiens
caauuauucaaaugcaaagaaaaua

SEQ ID NO: 5157 - RNA, 25 nt, Homo sapiens
ucguuguuuuggcgaccaaaaacac

SEQ ID NO: 5158 - RNA, 25 nt, Homo sapiens
aacccuauucaaacagucguuguuu

SEQ ID NO: 5159 - RNA, 25 nt, Homo sapiens
cgaacacugaacaaaucauucaucu

SEQ ID NO: 5160 - RNA, 25 nt, Homo sapiens
ccgaacacugaacaaaucauucauc

SEQ ID NO: 5161 - RNA, 25 nt, Homo sapiens
ugguugugaccgucuguuagacuag

SEQ ID NO: 5162 - RNA, 25 nt, Homo sapiens
uaauauccuugguuuuccauggcac

SEQ ID NO: 5163 - RNA, 25 nt, Homo sapiens
uuuugcuaauauccuugguuuucca

SEQ ID NO: 5164 - RNA, 25 nt, Homo sapiens
caacuucugcuuuugcuaauauccu

SEQ ID NO: 5165 - RNA, 25 nt, Homo sapiens
uacuguaagcagcuucggcuuccca

SEQ ID NO: 5166 - RNA, 25 nt, Homo sapiens
uugucccagcuacuguaagcagcuu

SEQ ID NO: 5167 - RNA, 25 nt, Homo sapiens
agaaaucauucaggaagcuucuuga

SEQ ID NO: 5168 - RNA, 25 nt, Homo sapiens
ggcucagggcuagcagaaaucauuc

SEQ ID NO: 5169 - RNA, 25 nt, Homo sapiens
agugcugguuccaaaaauaggcuca

SEQ ID NO: 5170 - RNA, 25 nt, Homo sapiens
aagugcugguuccaaaaauaggcuc

SEQ ID NO: 5171 - RNA, 25 nt, Homo sapiens
uuccccaagugcugguuccaaaaau

SEQ ID NO: 5172 - RNA, 25 nt, Homo sapiens
ucacaagaucaguuuccccaagugc

SEQ ID NO: 5173 - RNA, 25 nt, Homo sapiens
caagucuggggaugccccagugggg

SEQ ID NO: 5174 - RNA, 25 nt, Homo sapiens
ucccaagucuggggaugccccagug

SEQ ID NO: 5175 - RNA, 25 nt, Homo sapiens
uucccaagucuggggaugccccagu

SEQ ID NO: 5176 - RNA, 25 nt, Homo sapiens
uuucccaagucuggggaugccccag

SEQ ID NO: 5177 - RNA, 25 nt, Homo sapiens
gaaagagucacguuucccaagucug

SEQ ID NO: 5178 - RNA, 25 nt, Homo sapiens
agaaagagucacguuucccaagucu

SEQ ID NO: 5179 - RNA, 25 nt, Homo sapiens
aagaaagagucacguuucccaaguc

SEQ ID NO: 5180 - RNA, 25 nt, Homo sapiens
ucacuguggccugacuaaaacccag

SEQ ID NO: 5181 - RNA, 25 nt, Homo sapiens
cuguuagggcuguuccuucucacug

SEQ ID NO: 5182 - RNA, 25 nt, Homo sapiens
auucaaccuggcuggaggccuguua

SEQ ID NO: 5183 - RNA, 25 nt, Homo sapiens
cauucaaccuggcuggaggccuguu

SEQ ID NO: 5184 - RNA, 25 nt, Homo sapiens
aaaugagcucauucaaccuggcugg

SEQ ID NO: 5185 - RNA, 25 nt, Homo sapiens
caaaaaugagcucauucaaccuggc

SEQ ID NO: 5186 - RNA, 25 nt, Homo sapiens
acaacaaaaaugagcucauucaacc

SEQ ID NO: 5187 - RNA, 25 nt, Homo sapiens
uagaacauuagcaaaucuuacuggu

SEQ ID NO: 5188 - RNA, 25 nt, Homo sapiens
aauguagaacauuagcaaaucuuac

SEQ ID NO: 5189 - RNA, 25 nt, Homo sapiens
aggcaaagagggaugucuuuggaga

SEQ ID NO: 5190 - RNA, 25 nt, Homo sapiens
cauaugaggcaaagagggaugucuu

SEQ ID NO: 5191 - RNA, 25 nt, Homo sapiens
gaugauucaacauaugaggcaaaga

SEQ ID NO: 5192 - RNA, 25 nt, Homo sapiens
ggaugauucaacauaugaggcaaag

SEQ ID NO: 5193 - RNA, 25 nt, Homo sapiens
uccgcacuggaugauucaacauaug

SEQ ID NO: 5194 - RNA, 25 nt, Homo sapiens
gauauuuucauugaaauauccgcac

SEQ ID NO: 5195 - RNA, 25 nt, Homo sapiens
agaauccaaggaggccacaacuuca

SEQ ID NO: 5196 - RNA, 25 nt, Homo sapiens
aagccaaagucagaagaauccaagg

SEQ ID NO: 5197 - RNA, 25 nt, Homo sapiens
cagaagccaaagucagaagaaucca

SEQ ID NO: 5198 - RNA, 25 nt, Homo sapiens
aggaacuaccaccagggcuggaucu

SEQ ID NO: 5199 - RNA, 25 nt, Homo sapiens
cucagaaaggaacuaccaccagggc

SEQ ID NO: 5200 - RNA, 25 nt, Homo sapiens
agaccucagaaaggaacuaccacca

SEQ ID NO: 5201 - RNA, 25 nt, Homo sapiens
gagaccucagaaaggaacuaccacc

SEQ ID NO: 5202 - RNA, 25 nt, Homo sapiens
cucaagggacugagagaccucagaa

SEQ ID NO: 5203 - RNA, 25 nt, Homo sapiens
cagccaaacuaccccaaagucucaa

SEQ ID NO: 5204 - RNA, 25 nt, Homo sapiens
gcagccaaacuaccccaaagucuca

SEQ ID NO: 5205 - RNA, 25 nt, Homo sapiens
cugauauacauuuugucagugagaa

SEQ ID NO: 5206 - RNA, 25 nt, Homo sapiens
aaggaauauugggggguggaggugg

SEQ ID NO: 5207 - RNA, 25 nt, Homo sapiens
caaggaauauugggggguggaggug

SEQ ID NO: 5208 - RNA, 25 nt, Homo sapiens
ucaaggaauauugggggguggaggu

SEQ ID NO: 5209 - RNA, 25 nt, Homo sapiens
uucaaggaauauugggggguggagg

SEQ ID NO: 5210 - RNA, 25 nt, Homo sapiens
aaguucaaggaauauuggggggugg

SEQ ID NO: 5211 - RNA, 25 nt, Homo sapiens
ucaaaguucaaggaauauugggggg

SEQ ID NO: 5212 - RNA, 25 nt, Homo sapiens
aauucaaaguucaaggaauauuggg

SEQ ID NO: 5213 - RNA, 25 nt, Homo sapiens
caauucaaaguucaaggaauauugg

SEQ ID NO: 5214 - RNA, 25 nt, Homo sapiens
gcaauucaaaguucaaggaauauug

SEQ ID NO: 5215 - RNA, 25 nt, Homo sapiens
agcaauucaaaguucaaggaauauu

SEQ ID NO: 5216 - RNA, 25 nt, Homo sapiens
aagcaauucaaaguucaaggaauau

SEQ ID NO: 5217 - RNA, 25 nt, Homo sapiens
guguucugaagcaauucaaaguuca

SEQ ID NO: 5218 - RNA, 25 nt, Homo sapiens
acuucccuaauaagggaauaccuuc

SEQ ID NO: 5219 - RNA, 25 nt, Homo sapiens
gacagcagugacacuucccuaauaa

SEQ ID NO: 5220 - RNA, 25 nt, Homo sapiens
agacagcagugacacuucccuaaua

SEQ ID NO: 5221 - RNA, 25 nt, Homo sapiens
aagcuucuugcugcaaauacugaac

SEQ ID NO: 5222 - RNA, 25 nt, Homo sapiens
aagucaagacaaaaccaaagcaaaa

SEQ ID NO: 5223 - RNA, 25 nt, Homo sapiens
uuuguacaaucaaacucuugugugc

SEQ ID NO: 5224 - RNA, 25 nt, Homo sapiens
auaaaagcaacugaucuuaagcaac

SEQ ID NO: 5225 - RNA, 25 nt, Homo sapiens
ucuuauaacaaaacuagccaagauc

SEQ ID NO: 5226 - RNA, 25 nt, Homo sapiens
caugauaguuugcugaccucgugga

SEQ ID NO: 5227 - RNA, 25 nt, Homo sapiens
acaugauaguuugcugaccucgugg

SEQ ID NO: 5228 - RNA, 25 nt, Homo sapiens
agaacaugauaguuugcugaccucg

SEQ ID NO: 5229 - RNA, 25 nt, Homo sapiens
cuagggacuaugauaacucuggccu

SEQ ID NO: 5230 - RNA, 25 nt, Homo sapiens
agcaaccuagggacuaugauaacuc

SEQ ID NO: 5231 - RNA, 25 nt, Homo sapiens
gcacaugauaagccguagcaaccua

SEQ ID NO: 5232 - RNA, 25 nt, Homo sapiens
agcacaugauaagccguagcaaccu

SEQ ID NO: 5233 - RNA, 25 nt, Homo sapiens
cugacuuccucagaaaccaccucuu

SEQ ID NO: 5234 - RNA, 25 nt, Homo sapiens
acccauuacugacugcucuggcccu

SEQ ID NO: 5235 - RNA, 25 nt, Homo sapiens
cacccauuacugacugcucuggccc

SEQ ID NO: 5236 - RNA, 25 nt, Homo sapiens
cucauucacccauuacugacugcuc

SEQ ID NO: 5237 - RNA, 25 nt, Homo sapiens
uacccaccagcaaccuagaaguaga

SEQ ID NO: 5238 - RNA, 25 nt, Homo sapiens
uaauuuuaaaauccucagugagcua

SEQ ID NO: 5239 - RNA, 25 nt, Homo sapiens
aaaaaguuauuaagacugugaaauu

SEQ ID NO: 5240 - RNA, 25 nt, Homo sapiens
cauaaguuucagaagggccacacac

SEQ ID NO: 5241 - RNA, 25 nt, Homo sapiens
ggagagaugaccauaaguuucagaa

SEQ ID NO: 5242 - RNA, 25 nt, Homo sapiens
gggagagaugaccauaaguuucaga

SEQ ID NO: 5243 - RNA, 25 nt, Homo sapiens
cauuugaaaagaccuugguuucagu

SEQ ID NO: 5244 - RNA, 25 nt, Homo sapiens
acauuugaaaagaccuugguuucag

SEQ ID NO: 5245 - RNA, 25 nt, Homo sapiens
cauuuagccacauuugaaaagaccu

SEQ ID NO: 5246 - RNA, 25 nt, Homo sapiens
uccuggcuguuuccccgaagcaacu

SEQ ID NO: 5247 - RNA, 25 nt, Homo sapiens
cuaaaaauaaucuugaccauuuucc

SEQ ID NO: 5248 - RNA, 25 nt, Homo sapiens
augucuauagucuaaguuucccuua

SEQ ID NO: 5249 - RNA, 25 nt, Homo sapiens
aacauacagaaaacaaaagcugcac

SEQ ID NO: 5250 - RNA, 25 nt, Homo sapiens
uaacaaaggcauccugacaucaggg

SEQ ID NO: 5251 - RNA, 25 nt, Homo sapiens
uccuaacaaaggcauccugacauca

SEQ ID NO: 5252 - RNA, 25 nt, Homo sapiens
auccuaacaaaggcauccugacauc

SEQ ID NO: 5253 - RNA, 25 nt, Homo sapiens
uaagggcaaauacagauccuaacaa

SEQ ID NO: 5254 - RNA, 25 nt, Homo sapiens
ggaaaaaagauuucaacaaaauuaa

SEQ ID NO: 5255 - RNA, 25 nt, Homo sapiens
aggaaaaaagauuucaacaaaauua

SEQ ID NO: 5256 - RNA, 25 nt, Homo sapiens
auuuuggaacuuuucaagaggaaga

SEQ ID NO: 5257 - RNA, 25 nt, Homo sapiens
aaacuauauuuuggaacuuuucaag

SEQ ID NO: 5258 - RNA, 25 nt, Homo sapiens
augaaagauacaauaaacuauauuu

SEQ ID NO: 5259 - RNA, 25 nt, Homo sapiens
uugugugaacugcccauagugaaaa

SEQ ID NO: 5260 - RNA, 25 nt, Homo sapiens
uuauuaauuacaugauuugaggcuu

SEQ ID NO: 5261 - RNA, 25 nt, Homo sapiens
ggcaaauuauuaauuacaugauuug

SEQ ID NO: 5262 - RNA, 25 nt, Homo sapiens
aaucacaauuaggucauaaauaaac

SEQ ID NO: 5263 - RNA, 25 nt, Homo sapiens
uuuuauuaauaaaagaaucacaauu

SEQ ID NO: 5264 - RNA, 25 nt, Homo sapiens
guaggucuagucaucagcuuaauca

SEQ ID NO: 5265 - RNA, 25 nt, Homo sapiens
uguaggucuagucaucagcuuaauc

SEQ ID NO: 5266 - RNA, 25 nt, Homo sapiens
cauauacugcaggaaaauuaauugu

SEQ ID NO: 5267 - RNA, 25 nt, Homo sapiens
ucugguacaauacuucauauacugc

SEQ ID NO: 5268 - RNA, 25 nt, Homo sapiens
aaauauuacauaucuuuuaauacuc

SEQ ID NO: 5269 - RNA, 25 nt, Homo sapiens
acauccuaaaacguauuccuuuuaa

SEQ ID NO: 5270 - RNA, 25 nt, Homo sapiens
gacuacauaauauacgugggcaaaa

SEQ ID NO: 5271 - RNA, 25 nt, Homo sapiens
ugcaaauagacuacauaauauacgu

SEQ ID NO: 5272 - RNA, 25 nt, Homo sapiens
uugcaaauagacuacauaauauacg

SEQ ID NO: 5273 - RNA, 25 nt, Homo sapiens
gcgcuaacacccauaaauauaggug

SEQ ID NO: 5274 - RNA, 25 nt, Homo sapiens
ugcgcuaacacccauaaauauaggu

SEQ ID NO: 5275 - RNA, 25 nt, Homo sapiens
uugcgcuaacacccauaaauauagg

SEQ ID NO: 5276 - RNA, 25 nt, Homo sapiens
caguugcgcuaacacccauaaauau

SEQ ID NO: 5277 - RNA, 25 nt, Homo sapiens
cgacaaaugccaucauauaagaaaa

SEQ ID NO: 5278 - RNA, 25 nt, Homo sapiens
cccggccuucacgugaccuggcgug

SEQ ID NO: 5279 - RNA, 25 nt, Homo sapiens
ugaccuggcgugcggagcgcgcacg

SEQ ID NO: 5280 - RNA, 25 nt, Homo sapiens
gaccuggcgugcggagcgcgcacgc

SEQ ID NO: 5281 - RNA, 25 nt, Homo sapiens
ggagcgcgcacgcgggaacccgcgc

SEQ ID NO: 5282 - RNA, 25 nt, Homo sapiens
gcgcgcacgcgggaacccgcgcugg

SEQ ID NO: 5283 - RNA, 25 nt, Homo sapiens
cgcacgcgggaacccgcgcuggagg

SEQ ID NO: 5284 - RNA, 25 nt, Homo sapiens
gcacgcgggaacccgcgcuggaggc

SEQ ID NO: 5285 - RNA, 25 nt, Homo sapiens
cgggaacccgcgcuggaggcgggcg

SEQ ID NO: 5286 - RNA, 25 nt, Homo sapiens
gggaacccgcgcuggaggcgggcga

SEQ ID NO: 5287 - RNA, 25 nt, Homo sapiens
ccgcgcuggaggcgggcgagggccg

SEQ ID NO: 5288 - RNA, 25 nt, Homo sapiens
cgcgcuggaggcgggcgagggccga

SEQ ID NO: 5289 - RNA, 25 nt, Homo sapiens
gcgcuggaggcgggcgagggccgag

SEQ ID NO: 5290 - RNA, 25 nt, Homo sapiens
ggcgggcgagggccgaggggcagcu

SEQ ID NO: 5291 - RNA, 25 nt, Homo sapiens
gcgggcgagggccgaggggcagcua

SEQ ID NO: 5292 - RNA, 25 nt, Homo sapiens
agggccgaggggcagcuagggagcg

SEQ ID NO: 5293 - RNA, 25 nt, Homo sapiens
aggggcagcuagggagcgcggcuug

SEQ ID NO: 5294 - RNA, 25 nt, Homo sapiens
ggcagcuagggagcgcggcuugagg

SEQ ID NO: 5295 - RNA, 25 nt, Homo sapiens
gcagcuagggagcgcggcuugagga

SEQ ID NO: 5296 - RNA, 25 nt, Homo sapiens
gcuagggagcgcggcuugaggaggg

SEQ ID NO: 5297 - RNA, 25 nt, Homo sapiens
cuagggagcgcggcuugaggagggc

SEQ ID NO: 5298 - RNA, 25 nt, Homo sapiens
uagggagcgcggcuugaggagggcg

SEQ ID NO: 5299 - RNA, 25 nt, Homo sapiens
cuugaggagggcggggccgccccgc

SEQ ID NO: 5300 - RNA, 25 nt, Homo sapiens
gccaaagucaaaccccgacacccgc

SEQ ID NO: 5301 - RNA, 25 nt, Homo sapiens
aaagucaaaccccgacacccgccgg

SEQ ID NO: 5302 - RNA, 25 nt, Homo sapiens
aagucaaaccccgacacccgccggc

SEQ ID NO: 5303 - RNA, 25 nt, Homo sapiens
caaaccccgacacccgccggcgggc

SEQ ID NO: 5304 - RNA, 25 nt, Homo sapiens
gggccggugagcucacuagcugacc

SEQ ID NO: 5305 - RNA, 25 nt, Homo sapiens
cggugagcucacuagcugacccggc

SEQ ID NO: 5306 - RNA, 25 nt, Homo sapiens
agcucacuagcugacccggcagguc

SEQ ID NO: 5307 - RNA, 25 nt, Homo sapiens
cuagcugacccggcaggucaggauc

SEQ ID NO: 5308 - RNA, 25 nt, Homo sapiens
cccggcaggucaggaucuggcuuag

SEQ ID NO: 5309 - RNA, 25 nt, Homo sapiens
ccgcgagcuccagugcgcgcacccg

SEQ ID NO: 5310 - RNA, 25 nt, Homo sapiens
guggccgccucccagcccucuuugc

SEQ ID NO: 5311 - RNA, 25 nt, Homo sapiens
ccagcccucuuugccggacgagcuc

SEQ ID NO: 5312 - RNA, 25 nt, Homo sapiens
cagcccucuuugccggacgagcucu

SEQ ID NO: 5313 - RNA, 25 nt, Homo sapiens
cgagcucugggccgccacaagacua

SEQ ID NO: 5314 - RNA, 25 nt, Homo sapiens
ucugggccgccacaagacuaaggaa

SEQ ID NO: 5315 - RNA, 25 nt, Homo sapiens
ugcccgucuuucucagccagcucug

SEQ ID NO: 5316 - RNA, 25 nt, Homo sapiens
gcccgucuuucucagccagcucuga

SEQ ID NO: 5317 - RNA, 25 nt, Homo sapiens
cccgucuuucucagccagcucugag

SEQ ID NO: 5318 - RNA, 25 nt, Homo sapiens
cccgcaucaagaaaaucuccaucga

SEQ ID NO: 5319 - RNA, 25 nt, Homo sapiens
ccgcaucaagaaaaucuccaucgaa

SEQ ID NO: 5320 - RNA, 25 nt, Homo sapiens
agaaaaucuccaucgaagggaacau

SEQ ID NO: 5321 - RNA, 25 nt, Homo sapiens
aucuccaucgaagggaacaucggua

SEQ ID NO: 5322 - RNA, 25 nt, Homo sapiens
gaagggaacaucgguaaggagccuc

SEQ ID NO: 5323 - RNA, 25 nt, Homo sapiens
caucgguaaggagccuccggaaaug

SEQ ID NO: 5324 - RNA, 25 nt, Homo sapiens
aucgguaaggagccuccggaaaugu

SEQ ID NO: 5325 - RNA, 25 nt, Homo sapiens
cgcacgccaggucacgugaaggccg

SEQ ID NO: 5326 - RNA, 25 nt, Homo sapiens
ccgcacgccaggucacgugaaggcc

SEQ ID NO: 5327 - RNA, 25 nt, Homo sapiens
uccgcacgccaggucacgugaaggc

SEQ ID NO: 5328 - RNA, 25 nt, Homo sapiens
gcgcuccgcacgccaggucacguga

SEQ ID NO: 5329 - RNA, 25 nt, Homo sapiens
uucccgcgugcgcgcuccgcacgcc

SEQ ID NO: 5330 - RNA, 25 nt, Homo sapiens
cucggcccucgcccgccuccagcgc

SEQ ID NO: 5331 - RNA, 25 nt, Homo sapiens
ccucggcccucgcccgccuccagcg

SEQ ID NO: 5332 - RNA, 25 nt, Homo sapiens
caagccgcgcucccuagcugccccu

SEQ ID NO: 5333 - RNA, 25 nt, Homo sapiens
ugaggacacuggcgggccugcgggg

SEQ ID NO: 5334 - RNA, 25 nt, Homo sapiens
agcugaggacacuggcgggccugcg

SEQ ID NO: 5335 - RNA, 25 nt, Homo sapiens
cagcugaggacacuggcgggccugc

SEQ ID NO: 5336 - RNA, 25 nt, Homo sapiens
gcagcugaggacacuggcgggccug

SEQ ID NO: 5337 - RNA, 25 nt, Homo sapiens
cgcggaggcagcugaggacacuggc

SEQ ID NO: 5338 - RNA, 25 nt, Homo sapiens
gcgcggaggcagcugaggacacugg

SEQ ID NO: 5339 - RNA, 25 nt, Homo sapiens
ggcgcgcggaggcagcugaggacac

SEQ ID NO: 5340 - RNA, 25 nt, Homo sapiens
ugacuuuggcgcgcggaggcagcug

SEQ ID NO: 5341 - RNA, 25 nt, Homo sapiens
gucgggguuugacuuuggcgcgcgg

SEQ ID NO: 5342 - RNA, 25 nt, Homo sapiens
ggugucgggguuugacuuuggcgcg

SEQ ID NO: 5343 - RNA, 25 nt, Homo sapiens
gccggcgggugucgggguuugacuu

SEQ ID NO: 5344 - RNA, 25 nt, Homo sapiens
cucaccggcccgccggcgggugucg

SEQ ID NO: 5345 - RNA, 25 nt, Homo sapiens
gcucaccggcccgccggcggguguc

SEQ ID NO: 5346 - RNA, 25 nt, Homo sapiens
agcucaccggcccgccggcgggugu

SEQ ID NO: 5347 - RNA, 25 nt, Homo sapiens
cuagugagcucaccggcccgccggc

SEQ ID NO: 5348 - RNA, 25 nt, Homo sapiens
gcuagugagcucaccggcccgccgg

SEQ ID NO: 5349 - RNA, 25 nt, Homo sapiens
ucagcuagugagcucaccggcccgc

SEQ ID NO: 5350 - RNA, 25 nt, Homo sapiens
cugccgggucagcuagugagcucac

SEQ ID NO: 5351 - RNA, 25 nt, Homo sapiens
ccgcuaagccagauccugaccugcc

SEQ ID NO: 5352 - RNA, 25 nt, Homo sapiens
gccgcuaagccagauccugaccugc

SEQ ID NO: 5353 - RNA, 25 nt, Homo sapiens
ccacgggugcgcgcacuggagcucg

SEQ ID NO: 5354 - RNA, 25 nt, Homo sapiens
gggaggcggccacgggugcgcgcac

SEQ ID NO: 5355 - RNA, 25 nt, Homo sapiens
gcaaagagggcugggaggcggccac

SEQ ID NO: 5356 - RNA, 25 nt, Homo sapiens
ggcaaagagggcugggaggcggcca

SEQ ID NO: 5357 - RNA, 25 nt, Homo sapiens
ucguccggcaaagagggcugggagg

SEQ ID NO: 5358 - RNA, 25 nt, Homo sapiens
agcucguccggcaaagagggcuggg

SEQ ID NO: 5359 - RNA, 25 nt, Homo sapiens
cagagcucguccggcaaagagggcu

SEQ ID NO: 5360 - RNA, 25 nt, Homo sapiens
ccagagcucguccggcaaagagggc

SEQ ID NO: 5361 - RNA, 25 nt, Homo sapiens
cggcccagagcucguccggcaaaga

SEQ ID NO: 5362 - RNA, 25 nt, Homo sapiens
gcggcccagagcucguccggcaaag

SEQ ID NO: 5363 - RNA, 25 nt, Homo sapiens
gucuuguggcggcccagagcucguc

SEQ ID NO: 5364 - RNA, 25 nt, Homo sapiens
ggguggccauuccuuagucuugugg

SEQ ID NO: 5365 - RNA, 25 nt, Homo sapiens
gcgggguggccauuccuuagucuug

SEQ ID NO: 5366 - RNA, 25 nt, Homo sapiens
gacgggcagcuucucuugggcgggg

SEQ ID NO: 5367 - RNA, 25 nt, Homo sapiens
aaagacgggcagcuucucuugggcg

SEQ ID NO: 5368 - RNA, 25 nt, Homo sapiens
gaaagacgggcagcuucucuugggc

SEQ ID NO: 5369 - RNA, 25 nt, Homo sapiens
agaaagacgggcagcuucucuuggg

SEQ ID NO: 5370 - RNA, 25 nt, Homo sapiens
cugagaaagacgggcagcuucucuu

SEQ ID NO: 5371 - RNA, 25 nt, Homo sapiens
gcugagaaagacgggcagcuucucu

SEQ ID NO: 5372 - RNA, 25 nt, Homo sapiens
ccccucagagcuggcugagaaagac

SEQ ID NO: 5373 - RNA, 25 nt, Homo sapiens
uccccucagagcuggcugagaaaga

SEQ ID NO: 5374 - RNA, 25 nt, Homo sapiens
uucuugaugcggguccccucagagc

SEQ ID NO: 5375 - RNA, 25 nt, Homo sapiens
ccuucgauggagauuuucuugaugc

SEQ ID NO: 5376 - RNA, 25 nt, Homo sapiens
cccuucgauggagauuuucuugaug

SEQ ID NO: 5377 - RNA, 25 nt, Homo sapiens
ggcuccuuaccgauguucccuucga

SEQ ID NO: 5378 - RNA, 25 nt, Homo sapiens
uuuuaucuuuccucacaacagcugc

SEQ ID NO: 5379 - RNA, 25 nt, Homo sapiens
uuuaucuuuccucacaacagcugca

SEQ ID NO: 5380 - RNA, 25 nt, Homo sapiens
uauccuuaaacaauugugugaagau

SEQ ID NO: 5381 - RNA, 25 nt, Homo sapiens
auccuuaaacaauugugugaagauu

SEQ ID NO: 5382 - RNA, 25 nt, Homo sapiens
aaacaauugugugaagauugggaag

SEQ ID NO: 5383 - RNA, 25 nt, Homo sapiens
agugguuccugaaccuguugccaga

SEQ ID NO: 5384 - RNA, 25 nt, Homo sapiens
guucaaaguacucaagaugaauuug

SEQ ID NO: 5385 - RNA, 25 nt, Homo sapiens
uguugacuucccugcagcuguugug

SEQ ID NO: 5386 - RNA, 25 nt, Homo sapiens
uucccaaucuucacacaauuguuua

SEQ ID NO: 5387 - RNA, 25 nt, Homo sapiens
cauugcaccaucuggcaacagguuc

SEQ ID NO: 5388 - RNA, 25 nt, Homo sapiens
uuugaacauugcaccaucuggcaac

SEQ ID NO: 5389 - RNA, 25 nt, Homo sapiens
ugaguacuuugaacauugcaccauc

SEQ ID NO: 5390 - RNA, 25 nt, Homo sapiens
aggaacuuacaaugucucagaaaaa

SEQ ID NO: 5391 - RNA, 25 nt, Homo sapiens
aacuuacaaugucucagaaaaaugg

SEQ ID NO: 5392 - RNA, 25 nt, Homo sapiens
acuuacaaugucucagaaaaauggu

SEQ ID NO: 5393 - RNA, 25 nt, Homo sapiens
gaugauguaugagaaaccugaacga

SEQ ID NO: 5394 - RNA, 25 nt, Homo sapiens
uaagagcucagcuugccucucugaa

SEQ ID NO: 5395 - RNA, 25 nt, Homo sapiens
uuuugaacgaucuguguauagugac

SEQ ID NO: 5396 - RNA, 25 nt, Homo sapiens
guguauagugacagguauguauaaa

SEQ ID NO: 5397 - RNA, 25 nt, Homo sapiens
cagguauguauaaauggcuuguacg

SEQ ID NO: 5398 - RNA, 25 nt, Homo sapiens
uuuggaagguaaaagaccaucguuc

SEQ ID NO: 5399 - RNA, 25 nt, Homo sapiens
cgacugagacaggcauauguuugga

SEQ ID NO: 5400 - RNA, 25 nt, Homo sapiens
uauucgacugagacaggcauauguu

SEQ ID NO: 5401 - RNA, 25 nt, Homo sapiens
agcugagcucuuauucgacugagac

SEQ ID NO: 5402 - RNA, 25 nt, Homo sapiens
gcaucuuugagcuugccauucagag

SEQ ID NO: 5403 - RNA, 25 nt, Homo sapiens
acacagaucguucaaaaaauaauac

SEQ ID NO: 5404 - RNA, 25 nt, Homo sapiens
aucugaaugcaugaaugagacagag

SEQ ID NO: 5405 - RNA, 25 nt, Homo sapiens
gacagaguggacaauuuaucaagac

SEQ ID NO: 5406 - RNA, 25 nt, Homo sapiens
gacaauuuaucaagacuggcaugac

SEQ ID NO: 5407 - RNA, 25 nt, Homo sapiens
ggcaugacuggaugaauaaccaauu

SEQ ID NO: 5408 - RNA, 25 nt, Homo sapiens
aaccaauuuggccaaagccuugaau

SEQ ID NO: 5409 - RNA, 25 nt, Homo sapiens
aauuuggccaaagccuugaauugga

SEQ ID NO: 5410 - RNA, 25 nt, Homo sapiens
aucauuuaucuucaagccacuccag

SEQ ID NO: 5411 - RNA, 25 nt, Homo sapiens
auccaauucaaggcuuuggccaaau

SEQ ID NO: 5412 - RNA, 25 nt, Homo sapiens
aaugauuccauccaauucaaggcuu

SEQ ID NO: 5413 - RNA, 25 nt, Homo sapiens
aagauaaaugauuccauccaauuca

SEQ ID NO: 5414 - RNA, 25 nt, Homo sapiens
uuuuuauuggguuuuaccucuggag

SEQ ID NO: 5415 - RNA, 25 nt, Homo sapiens
acacauuuuuauuggguuuuaccuc

SEQ ID NO: 5416 - RNA, 25 nt, Homo sapiens
gacaugcuuacauagaauauauuua

SEQ ID NO: 5417 - RNA, 25 nt, Homo sapiens
acaugcuuacauagaauauauuuac

SEQ ID NO: 5418 - RNA, 25 nt, Homo sapiens
caugcuuacauagaauauauuuacg

SEQ ID NO: 5419 - RNA, 25 nt, Homo sapiens
auuuacggggaagaaaugaagagca

SEQ ID NO: 5420 - RNA, 25 nt, Homo sapiens
gaagcuucauuauaaacaugaaagc

SEQ ID NO: 5421 - RNA, 25 nt, Homo sapiens
uaaacaugaaagcuggcuccugcau

SEQ ID NO: 5422 - RNA, 25 nt, Homo sapiens
augucuaaaagcaaguaauaagaga

SEQ ID NO: 5423 - RNA, 25 nt, Homo sapiens
aaugaagcuucucuaaauauucaag

SEQ ID NO: 5424 - RNA, 25 nt, Homo sapiens
uaagucuuacuucaguguccuaugc

SEQ ID NO: 5425 - RNA, 25 nt, Homo sapiens
agaaccaacuucgauuaucuucaag

SEQ ID NO: 5426 - RNA, 25 nt, Homo sapiens
cuucaagaggugccuaucuuaacac

SEQ ID NO: 5427 - RNA, 25 nt, Homo sapiens
gacuuuaaagacaaauaugaaaguc

SEQ ID NO: 5428 - RNA, 25 nt, Homo sapiens
gacaaauaugaaagucugguugaaa

SEQ ID NO: 5429 - RNA, 25 nt, Homo sapiens
ggcaccucuugaagauaaucgaagu

SEQ ID NO: 5430 - RNA, 25 nt, Homo sapiens
cuucauuaacauccaguguuaagau

SEQ ID NO: 5431 - RNA, 25 nt, Homo sapiens
acuuugugaucuugcugaagacuac

SEQ ID NO: 5432 - RNA, 25 nt, Homo sapiens
uugcugaagacuacaggcagccaaa

SEQ ID NO: 5433 - RNA, 25 nt, Homo sapiens
caaguuuuuaaucguuuuuguuuua

SEQ ID NO: 5434 - RNA, 25 nt, Homo sapiens
uccucagcagguuggcuuuuuuccc

SEQ ID NO: 5435 - RNA, 25 nt, Homo sapiens
uuuucccuggugccucucacuucgu

SEQ ID NO: 5436 - RNA, 25 nt, Homo sapiens
gaaagcuuuaauguuacauaguaaa

SEQ ID NO: 5437 - RNA, 25 nt, Homo sapiens
aguguaccuauuaaaaguugcaaag

SEQ ID NO: 5438 - RNA, 25 nt, Homo sapiens
auuaaaaguugcaaaguggaauuaa

SEQ ID NO: 5439 - RNA, 25 nt, Homo sapiens
uggaauuaaaggaaucccuagaaua

SEQ ID NO: 5440 - RNA, 25 nt, Homo sapiens
gccucagucugcuuucucuacuguc

SEQ ID NO: 5441 - RNA, 25 nt, Homo sapiens
gcuuucucuacugucuggauuaauu

SEQ ID NO: 5442 - RNA, 25 nt, Homo sapiens
cugaaagcauuauuuuuuguugaau

SEQ ID NO: 5443 - RNA, 25 nt, Homo sapiens
uaggaaauaaaauuaaugaagacag

SEQ ID NO: 5444 - RNA, 25 nt, Homo sapiens
ugugaauauuuguaaaaauaaugaa

SEQ ID NO: 5445 - RNA, 25 nt, Homo sapiens
auuuucuuucuaguuuguuuaguua

SEQ ID NO: 5446 - RNA, 25 nt, Homo sapiens
agaaaauuuuauguauuuuaaaaua

SEQ ID NO: 5447 - RNA, 25 nt, Homo sapiens
gaaaauuuuauguauuuuaaaauaa

SEQ ID NO: 5448 - RNA, 25 nt, Homo sapiens
aaaauuuuauguauuuuaaaauaag

SEQ ID NO: 5449 - RNA, 25 nt, Homo sapiens
uuucuuuccaagucauuuuuguuuu

SEQ ID NO: 5450 - RNA, 25 nt, Homo sapiens
uucuuauucaaagaugauaauuuag

SEQ ID NO: 5451 - RNA, 25 nt, Homo sapiens
aguccagacgcacugaucuuugcaa

SEQ ID NO: 5452 - RNA, 25 nt, Homo sapiens
ugcauuuuuuuaguuuguuuuuguu

SEQ ID NO: 5453 - RNA, 25 nt, Homo sapiens
uaaguauaaaccuuaugaacuacag

SEQ ID NO: 5454 - RNA, 25 nt, Homo sapiens
cuuuuaaauaaauuaugaauauuaa

SEQ ID NO: 5455 - RNA, 25 nt, Homo sapiens
uaaauuacuuugauuccauuuuaag

SEQ ID NO: 5456 - RNA, 25 nt, Homo sapiens
ucaugacucaaaaguugucucagug

SEQ ID NO: 5457 - RNA, 25 nt, Homo sapiens
ugacucaaaaguugucucagugugg

SEQ ID NO: 5458 - RNA, 25 nt, Homo sapiens
cucaaaaacucuuugaccugaggaa

SEQ ID NO: 5459 - RNA, 25 nt, Homo sapiens
aaguacucaaaaacucuuugaccug

SEQ ID NO: 5460 - RNA, 25 nt, Homo sapiens
caaagcugaaguaucuggaaccauu

SEQ ID NO: 5461 - RNA, 25 nt, Homo sapiens
cgaagauacacaaagcugaaguauc

SEQ ID NO: 5462 - RNA, 25 nt, Homo sapiens
uuaaaacaaaaacgauuaaaaacuu

SEQ ID NO: 5463 - RNA, 25 nt, Homo sapiens
cuuaaaacaaaaacgauuaaaaacu

SEQ ID NO: 5464 - RNA, 25 nt, Homo sapiens
uuuuuuuuuuguuuucuuuucuuuc

SEQ ID NO: 5465 - RNA, 25 nt, Homo sapiens
gucaccaacgaagugagaggcacca

SEQ ID NO: 5466 - RNA, 25 nt, Homo sapiens
ggucaccaacgaagugagaggcacc

SEQ ID NO: 5467 - RNA, 25 nt, Homo sapiens
agaaacuggucaccaacgaagugag

SEQ ID NO: 5468 - RNA, 25 nt, Homo sapiens
cauuaaagcuuucaguuuaagaaac

SEQ ID NO: 5469 - RNA, 25 nt, Homo sapiens
uuuuaauagguacacuaauuuacac

SEQ ID NO: 5470 - RNA, 25 nt, Homo sapiens
uuaauuccacuuugcaacuuuuaau

SEQ ID NO: 5471 - RNA, 25 nt, Homo sapiens
auaaaacuucagaauccuuauucua

SEQ ID NO: 5472 - RNA, 25 nt, Homo sapiens
aauaaaacuucagaauccuuauucu

SEQ ID NO: 5473 - RNA, 25 nt, Homo sapiens
cagacugaggcaggaaguaagaggu

SEQ ID NO: 5474 - RNA, 25 nt, Homo sapiens
gcagacugaggcaggaaguaagagg

SEQ ID NO: 5475 - RNA, 25 nt, Homo sapiens
aaagcagacugaggcaggaaguaag

SEQ ID NO: 5476 - RNA, 25 nt, Homo sapiens
gacaguagagaaagcagacugaggc

SEQ ID NO: 5477 - RNA, 25 nt, Homo sapiens
uccagacaguagagaaagcagacug

SEQ ID NO: 5478 - RNA, 25 nt, Homo sapiens
aaaugugugacuuuaacuuuauagc

SEQ ID NO: 5479 - RNA, 25 nt, Homo sapiens
cuauucaacaaaaaauaaugcuuuc

SEQ ID NO: 5480 - RNA, 25 nt, Homo sapiens
uaguuaagugugucucauuaauuaa

SEQ ID NO: 5481 - RNA, 25 nt, Homo sapiens
uuauuuuuacaaauauucacauaga

SEQ ID NO: 5482 - RNA, 25 nt, Homo sapiens
cguaaaauggaaagguuuaauacac

SEQ ID NO: 5483 - RNA, 25 nt, Homo sapiens
aaauuuucuaaaacguaaaauggaa

SEQ ID NO: 5484 - RNA, 25 nt, Homo sapiens
acauaaaauuuucuaaaacguaaaa

SEQ ID NO: 5485 - RNA, 25 nt, Homo sapiens
uaagaaaccaaaaacaaaaaugacu

SEQ ID NO: 5486 - RNA, 25 nt, Homo sapiens
uuugcaaagaucagugcgucuggac

SEQ ID NO: 5487 - RNA, 25 nt, Homo sapiens
ucuccuuugcaaagaucagugcguc

SEQ ID NO: 5488 - RNA, 25 nt, Homo sapiens
uacguauaaugagacaguuuaugua

SEQ ID NO: 5489 - RNA, 25 nt, Homo sapiens
gaguguagcuccacuguaguucaua

SEQ ID NO: 5490 - RNA, 25 nt, Homo sapiens
cacugaaauaugucuccacuuaaaa

SEQ ID NO: 5491 - RNA, 25 nt, Homo sapiens
uuuaaaagucauuauacauuuuuaa

SEQ ID NO: 5492 - RNA, 20 nt, Homo sapiens
cacgcguuuaauauaagugg

SEQ ID NO: 5493 - RNA, 20 nt, Homo sapiens
uauaaguggaggcgucgcgc

SEQ ID NO: 5494 - RNA, 20 nt, Homo sapiens
aaguggaggcgucgcgcugg

SEQ ID NO: 5495 - RNA, 20 nt, Homo sapiens
ggccgagaugucucgcuccg

SEQ ID NO: 5496 - RNA, 20 nt, Homo sapiens
ggccacggagcgagacaucu

SEQ ID NO: 5497 - RNA, 20 nt, Homo sapiens
cgcgagcacagcuaaggcca

SEQ ID NO: 5498 - RNA, 20 nt, Homo sapiens
gaguagcgcgagcacagcua

SEQ ID NO: 5499 - RNA, 20 nt, Homo sapiens
acucacgcuggauagccucc

SEQ ID NO: 5500 - RNA, 20 nt, Homo sapiens
aggguaggagagacucacgc

SEQ ID NO: 5501 - RNA, 20 nt, Homo sapiens
cucagguacuccaaagauuc

SEQ ID NO: 5502 - RNA, 20 nt, Homo sapiens
cgugaguaaaccugaaucuu

SEQ ID NO: 5503 - RNA, 20 nt, Homo sapiens
caguaagucaacuucaaugu

SEQ ID NO: 5504 - RNA, 20 nt, Homo sapiens
acuugucuuucagcaaggac

SEQ ID NO: 5505 - RNA, 20 nt, Homo sapiens
agucacaugguucacacggc

SEQ ID NO: 5506 - RNA, 20 nt, Homo sapiens
acaaagucacaugguucaca

SEQ ID NO: 5507 - RNA, 20 nt, Homo sapiens
cacagcccaagauaguuaag

SEQ ID NO: 5508 - RNA, 20 nt, Homo sapiens
acagcccaagauaguuaagu

SEQ ID NO: 5509 - RNA, 20 nt, Homo sapiens
uuaccccacuuaacuaucuu

SEQ ID NO: 5510 - RNA, 20 nt, Homo sapiens
cuuaccccacuuaacuaucu

SEQ ID NO: 5511 - RNA, 20 nt, Homo sapiens
agguuugaagaugccgcauu

SEQ ID NO: 5512 - RNA, 20 nt, Homo sapiens
ugaagaugccgcauuuggau

SEQ ID NO: 5513 - RNA, 20 nt, Homo sapiens
gaauucauccaauccaaaug

SEQ ID NO: 5514 - RNA, 20 nt, Homo sapiens
acacuuuaugcacaaaaugu

SEQ ID NO: 5515 - RNA, 20 nt, Homo sapiens
cugcucagauacaucaaaca

SEQ ID NO: 5516 - RNA, 20 nt, Homo sapiens
cauguuugauguaucugagc

SEQ ID NO: 5517 - RNA, 20 nt, Homo sapiens
aucugagcagguugcuccac

SEQ ID NO: 5518 - RNA, 20 nt, Homo sapiens
gcuccacagguagcucuagg

SEQ ID NO: 5519 - RNA, 20 nt, Homo sapiens
uaggagggcuggcaacuuag

SEQ ID NO: 5520 - RNA, 20 nt, Homo sapiens
gagggcuggcaacuuagagg

SEQ ID NO: 5521 - RNA, 20 nt, Homo sapiens
agggcuggcaacuuagaggu

SEQ ID NO: 5522 - RNA, 20 nt, Homo sapiens
gggcuggcaacuuagaggug

SEQ ID NO: 5523 - RNA, 20 nt, Homo sapiens
ucugaccaagauguugaugu

SEQ ID NO: 5524 - RNA, 20 nt, Homo sapiens
ucuaagcagaguauguaaau

SEQ ID NO: 5525 - RNA, 20 nt, Homo sapiens
aauauaauugacaggauuau

SEQ ID NO: 5526 - RNA, 20 nt, Homo sapiens
cuuauacauuugauaaagua

SEQ ID NO: 5527 - RNA, 20 nt, Homo sapiens
aggcaugguugugguuaauc

SEQ ID NO: 5528 - RNA, 20 nt, Homo sapiens
cucaagguucagaucagaag

SEQ ID NO: 5529 - RNA, 20 nt, Homo sapiens
aagguucagaucagaagagg

SEQ ID NO: 5530 - RNA, 20 nt, Homo sapiens
gaggcuucucacccugcagc

SEQ ID NO: 5531 - RNA, 20 nt, Homo sapiens
aggcuucucacccugcagca

SEQ ID NO: 5532 - RNA, 20 nt, Homo sapiens
gcucacaggucccugcugca

SEQ ID NO: 5533 - RNA, 20 nt, Homo sapiens
ugcucacaggucccugcugc

SEQ ID NO: 5534 - RNA, 20 nt, Homo sapiens
gcagcagggaccugugagca

SEQ ID NO: 5535 - RNA, 20 nt, Homo sapiens
ccugugagcauggcaugccc

SEQ ID NO: 5536 - RNA, 20 nt, Homo sapiens
ccagggcaugccaugcucac

SEQ ID NO: 5537 - RNA, 20 nt, Homo sapiens
caagugcccacaggaagcca

SEQ ID NO: 5538 - RNA, 20 nt, Homo sapiens
acaagugcccacaggaagcc

SEQ ID NO: 5539 - RNA, 20 nt, Homo sapiens
uggagaucacaagugcccac

SEQ ID NO: 5540 - RNA, 20 nt, Homo sapiens
gccuuccuuaccaagacagg

SEQ ID NO: 5541 - RNA, 20 nt, Homo sapiens
ugcgccuuccuuaccaagac

SEQ ID NO: 5542 - RNA, 20 nt, Homo sapiens
cuuucccacagaauuuagca

SEQ ID NO: 5543 - RNA, 20 nt, Homo sapiens
accagagaugucugugcagg

SEQ ID NO: 5544 - RNA, 20 nt, Homo sapiens
gccuccugcacagacaucuc

SEQ ID NO: 5545 - RNA, 20 nt, Homo sapiens
auaugugcagcucaggguca

SEQ ID NO: 5546 - RNA, 20 nt, Homo sapiens
ggugucauaugugcagcuca

SEQ ID NO: 5547 - RNA, 20 nt, Homo sapiens
uggugucauaugugcagcuc

SEQ ID NO: 5548 - RNA, 20 nt, Homo sapiens
uaaauaauaaucacucucac

SEQ ID NO: 5549 - RNA, 20 nt, Homo sapiens
agagugauuauuauuuauuc

SEQ ID NO: 5550 - RNA, 20 nt, Homo sapiens
gguacaagcagccucccagc

SEQ ID NO: 5551 - RNA, 20 nt, Homo sapiens
agaaucaucugccugcuggg

SEQ ID NO: 5552 - RNA, 20 nt, Homo sapiens
acgagaaucaucugccugcu

SEQ ID NO: 5553 - RNA, 20 nt, Homo sapiens
aacgagaaucaucugccugc

SEQ ID NO: 5554 - RNA, 20 nt, Homo sapiens
ucuguugcuuauaagcuucu

SEQ ID NO: 5555 - RNA, 20 nt, Homo sapiens
guuggugagguugauaaauu

SEQ ID NO: 5556 - RNA, 20 nt, Homo sapiens
gcuguaugugugaguuggug

SEQ ID NO: 5557 - RNA, 20 nt, Homo sapiens
accaacucacacauacagcc

SEQ ID NO: 5558 - RNA, 20 nt, Homo sapiens
ccaacucacacauacagcca

SEQ ID NO: 5559 - RNA, 20 nt, Homo sapiens
agcacaagaauauagauccc

SEQ ID NO: 5560 - RNA, 20 nt, Homo sapiens
uauucuugugcucucagaga

SEQ ID NO: 5561 - RNA, 20 nt, Homo sapiens
ggaaacacaccucuugucuu

SEQ ID NO: 5562 - RNA, 20 nt, Homo sapiens
cacaccucuugucuuuggaa

SEQ ID NO: 5563 - RNA, 20 nt, Homo sapiens
acaccucuugucuuuggaaa

SEQ ID NO: 5564 - RNA, 20 nt, Homo sapiens
gugcccuuuccaaagacaag

SEQ ID NO: 5565 - RNA, 20 nt, Homo sapiens
acacggcagggucaggguuc

SEQ ID NO: 5566 - RNA, 20 nt, Homo sapiens
agcugguacacggcaggguc

SEQ ID NO: 5567 - RNA, 20 nt, Homo sapiens
cucucagcugguacacggca

SEQ ID NO: 5568 - RNA, 20 nt, Homo sapiens
ucucucagcugguacacggc

SEQ ID NO: 5569 - RNA, 20 nt, Homo sapiens
agagucucucagcugguaca

SEQ ID NO: 5570 - RNA, 20 nt, Homo sapiens
uggauuuagagucucucagc

SEQ ID NO: 5571 - RNA, 20 nt, Homo sapiens
uaggcagacagacuugucac

SEQ ID NO: 5572 - RNA, 20 nt, Homo sapiens
gagaaucaaaaucggugaau

SEQ ID NO: 5573 - RNA, 20 nt, Homo sapiens
auuuguuugagaaucaaaau

SEQ ID NO: 5574 - RNA, 20 nt, Homo sapiens
aacaaaugugucacaaagua

SEQ ID NO: 5575 - RNA, 20 nt, Homo sapiens
acaaaacugugcuagacaug

SEQ ID NO: 5576 - RNA, 20 nt, Homo sapiens
ugugcuagacaugaggucua

SEQ ID NO: 5577 - RNA, 20 nt, Homo sapiens
cuucaagagcaacagugcug

SEQ ID NO: 5578 - RNA, 20 nt, Homo sapiens
agagcaacagugcuguggcc

SEQ ID NO: 5579 - RNA, 20 nt, Homo sapiens
aaagucagauuuguugcucc

SEQ ID NO: 5580 - RNA, 20 nt, Homo sapiens
uggaauaaugcuguuguuga

SEQ ID NO: 5581 - RNA, 20 nt, Homo sapiens
cuggggaagaaggugucuuc

SEQ ID NO: 5582 - RNA, 20 nt, Homo sapiens
agcugcccuuaccugggcug

SEQ ID NO: 5583 - RNA, 20 nt, Homo sapiens
aagcugcccuuaccugggcu

SEQ ID NO: 5584 - RNA, 20 nt, Homo sapiens
aaagcugcccuuaccugggc

SEQ ID NO: 5585 - RNA, 20 nt, Homo sapiens
caccaaagcugcccuuaccu

SEQ ID NO: 5586 - RNA, 20 nt, Homo sapiens
gcaccaaagcugcccuuacc

SEQ ID NO: 5587 - RNA, 20 nt, Homo sapiens
aaguuccugugaugucaagc

SEQ ID NO: 5588 - RNA, 20 nt, Homo sapiens
cucgaccagcuugacaucac

SEQ ID NO: 5589 - RNA, 20 nt, Homo sapiens
cugacagguuuugaaaguuu

SEQ ID NO: 5590 - RNA, 20 nt, Homo sapiens
uuucaaaaccugucagugau

SEQ ID NO: 5591 - RNA, 20 nt, Homo sapiens
uucaaaaccugucagugauu

SEQ ID NO: 5592 - RNA, 20 nt, Homo sapiens
uucggaacccaaucacugac

SEQ ID NO: 5593 - RNA, 20 nt, Homo sapiens
ccgaauccuccuccugaaag

SEQ ID NO: 5594 - RNA, 20 nt, Homo sapiens
ccacuuucaggaggaggauu

SEQ ID NO: 5595 - RNA, 20 nt, Homo sapiens
auccuccuccugaaaguggc

SEQ ID NO: 5596 - RNA, 20 nt, Homo sapiens
uccuccuccugaaaguggcc

SEQ ID NO: 5597 - RNA, 20 nt, Homo sapiens
acccggccacuuucaggagg

SEQ ID NO: 5598 - RNA, 20 nt, Homo sapiens
uaaacccggccacuuucagg

SEQ ID NO: 5599 - RNA, 20 nt, Homo sapiens
gauuaaacccggccacuuuc

SEQ ID NO: 5600 - RNA, 20 nt, Homo sapiens
cgucaugagcagauuaaacc

SEQ ID NO: 5601 - RNA, 20 nt, Homo sapiens
uuaaucugcucaugacgcug

SEQ ID NO: 5602 - RNA, 20 nt, Homo sapiens
ugcucaugacgcugcggcug

SEQ ID NO: 5603 - RNA, 20 nt, Homo sapiens
ucaaggccccucaccucagc

SEQ ID NO: 5604 - RNA, 20 nt, Homo sapiens
aggaaggagcgagggagcac

SEQ ID NO: 5605 - RNA, 20 nt, Homo sapiens
caaugcagaggaaggagcga

SEQ ID NO: 5606 - RNA, 20 nt, Homo sapiens
gcaaugcagaggaaggagcg

SEQ ID NO: 5607 - RNA, 20 nt, Homo sapiens
aagaggggcaaugcagagga

SEQ ID NO: 5608 - RNA, 20 nt, Homo sapiens
ggagaagaggggcaaugcag

SEQ ID NO: 5609 - RNA, 20 nt, Homo sapiens
ucuguuuggagagggagaag

SEQ ID NO: 5610 - RNA, 20 nt, Homo sapiens
ucuucucccucuccaaacag

SEQ ID NO: 5611 - RNA, 20 nt, Homo sapiens
cuucucccucuccaaacaga

SEQ ID NO: 5612 - RNA, 20 nt, Homo sapiens
gaguucccucuguuuggaga

SEQ ID NO: 5613 - RNA, 20 nt, Homo sapiens
agaguucccucuguuuggag

SEQ ID NO: 5614 - RNA, 20 nt, Homo sapiens
guaggagaguucccucuguu

SEQ ID NO: 5615 - RNA, 20 nt, Homo sapiens
gaacucuccuacccccaagg

SEQ ID NO: 5616 - RNA, 20 nt, Homo sapiens
gcuuucaccuccuugggggu

SEQ ID NO: 5617 - RNA, 20 nt, Homo sapiens
agcagcuuucaccuccuugg

SEQ ID NO: 5618 - RNA, 20 nt, Homo sapiens
uagcagcuuucaccuccuug

SEQ ID NO: 5619 - RNA, 20 nt, Homo sapiens
guagcagcuuucaccuccuu

SEQ ID NO: 5620 - RNA, 20 nt, Homo sapiens
cuaccaccucugugcccccc

SEQ ID NO: 5621 - RNA, 20 nt, Homo sapiens
uugccgggggggcacagagg

SEQ ID NO: 5622 - RNA, 20 nt, Homo sapiens
gcauugccgggggggcacag

SEQ ID NO: 5623 - RNA, 20 nt, Homo sapiens
aguugguggcauugccgggg

SEQ ID NO: 5624 - RNA, 20 nt, Homo sapiens
cagggaagaagccuguggcc

SEQ ID NO: 5625 - RNA, 20 nt, Homo sapiens
guggucagggaagaagccug

SEQ ID NO: 5626 - RNA, 20 nt, Homo sapiens
cugaccacguggagcugagc

SEQ ID NO: 5627 - RNA, 20 nt, Homo sapiens
cacggacccgcagccccuca

SEQ ID NO: 5628 - RNA, 20 nt, Homo sapiens
ggugcacaguggggucagca

SEQ ID NO: 5629 - RNA, 20 nt, Homo sapiens
gacggguuuggcccuauccu

SEQ ID NO: 5630 - RNA, 20 nt, Homo sapiens
uggcucaaacacagcgaccu

SEQ ID NO: 5631 - RNA, 20 nt, Homo sapiens
aggcuucuucccugaccacg

SEQ ID NO: 5632 - RNA, 20 nt, Homo sapiens
cagcucagcuccacgugguc

SEQ ID NO: 5633 - RNA, 20 nt, Homo sapiens
gcgcugacgaucugggugac

SEQ ID NO: 5634 - RNA, 20 nt, Homo sapiens
cuuuccagaggaccugaaca

SEQ ID NO: 5635 - RNA, 20 nt, Homo sapiens
ucaaacacagcgaccucggg

SEQ ID NO: 5636 - RNA, 20 nt, Homo sapiens
ugacggguuuggcccuaucc

SEQ ID NO: 5637 - RNA, 20 nt, Homo sapiens
ggcgcugacgaucuggguga

SEQ ID NO: 5638 - RNA, 20 nt, Homo sapiens
cgggugggaacaccuuguuc

SEQ ID NO: 5639 - RNA, 20 nt, Homo sapiens
gaacaagguguucccacccg

SEQ ID NO: 5640 - RNA, 20 nt, Homo sapiens
caaacacagcgaccucgggu

SEQ ID NO: 5641 - RNA, 20 nt, Homo sapiens
ggcucaaacacagcgaccuc

SEQ ID NO: 5642 - RNA, 20 nt, Homo sapiens
agcucagcuccacgugguca

SEQ ID NO: 5643 - RNA, 20 nt, Homo sapiens
gacgaucugggugacggguu

SEQ ID NO: 5644 - RNA, 20 nt, Homo sapiens
uaucaggcuccucugcuacg

SEQ ID NO: 5645 - RNA, 20 nt, Homo sapiens
aucaggcuccucugcuacgu

SEQ ID NO: 5646 - RNA, 20 nt, Homo sapiens
cuacgugggcuuuuauuuuc

SEQ ID NO: 5647 - RNA, 20 nt, Homo sapiens
acgugggcuuuuauuuucug

SEQ ID NO: 5648 - RNA, 20 nt, Homo sapiens
cgugggcuuuuauuuucugg

SEQ ID NO: 5649 - RNA, 20 nt, Homo sapiens
aauaaaagcccacguagcag

SEQ ID NO: 5650 - RNA, 20 nt, Homo sapiens
accccaagauaccuuguuau

SEQ ID NO: 5651 - RNA, 20 nt, Homo sapiens
agauaccuuguuauagggac

SEQ ID NO: 5652 - RNA, 20 nt, Homo sapiens
gacaggaaagaagaucacuc

SEQ ID NO: 5653 - RNA, 20 nt, Homo sapiens
ucuggaauguucucaaacca

SEQ ID NO: 5654 - RNA, 20 nt, Homo sapiens
cuggaauguucucaaaccau

SEQ ID NO: 5655 - RNA, 20 nt, Homo sapiens
uacugguaucaacaagaucc

SEQ ID NO: 5656 - RNA, 20 nt, Homo sapiens
guaucaacaagauccaggaa

SEQ ID NO: 5657 - RNA, 20 nt, Homo sapiens
caccucauccacuauuccua

SEQ ID NO: 5658 - RNA, 20 nt, Homo sapiens
ggaguuaauuccacagagaa

SEQ ID NO: 5659 - RNA, 20 nt, Homo sapiens
agucaacagucuccagaaua

SEQ ID NO: 5660 - RNA, 20 nt, Homo sapiens
aacagucuccagaauaagga

SEQ ID NO: 5661 - RNA, 20 nt, Homo sapiens
cccugacccuggagucugcc

SEQ ID NO: 5662 - RNA, 20 nt, Homo sapiens
uaacaagguaucuugggguc

SEQ ID NO: 5663 - RNA, 20 nt, Homo sapiens
cccuauaacaagguaucuug

SEQ ID NO: 5664 - RNA, 20 nt, Homo sapiens
ucccuauaacaagguaucuu

SEQ ID NO: 5665 - RNA, 20 nt, Homo sapiens
gucccuauaacaagguaucu

SEQ ID NO: 5666 - RNA, 20 nt, Homo sapiens
ucuuuccugucccuauaaca

SEQ ID NO: 5667 - RNA, 20 nt, Homo sapiens
gauaccaguacauuuuguca

SEQ ID NO: 5668 - RNA, 20 nt, Homo sapiens
augagguguaguuccauucc

SEQ ID NO: 5669 - RNA, 20 nt, Homo sapiens
cuccauaggaauaguggaug

SEQ ID NO: 5670 - RNA, 20 nt, Homo sapiens
aauuaacuccauaggaauag

SEQ ID NO: 5671 - RNA, 20 nt, Homo sapiens
cucuguggaauuaacuccau

SEQ ID NO: 5672 - RNA, 20 nt, Homo sapiens
ucuggagacuguugacucag

SEQ ID NO: 5673 - RNA, 20 nt, Homo sapiens
aaaaugcuccguccuuauuc

SEQ ID NO: 5674 - RNA, 20 nt, Homo sapiens
ccuggcagacuccaggguca

SEQ ID NO: 5675 - RNA, 20 nt, Homo sapiens
gccuggcagacuccaggguc

SEQ ID NO: 5676 - RNA, 20 nt, Homo sapiens
ugagggccuggcagacucca

SEQ ID NO: 5677 - RNA, 20 nt, Homo sapiens
gugagggccuggcagacucc

SEQ ID NO: 5678 - RNA, 20 nt, Homo sapiens
gagguacugagagguaugug

SEQ ID NO: 5679 - RNA, 20 nt, Homo sapiens
gcuggcacagagguacugag

SEQ ID NO: 5680 - RNA, 20 nt, Homo sapiens
uguauucacugcuggcacag

SEQ ID NO: 5681 - RNA, 20 nt, Homo sapiens
gagcugucugguucugguag

SEQ ID NO: 5682 - RNA, 20 nt, Homo sapiens
agagcugucugguucuggua

SEQ ID NO: 5683 - RNA, 20 nt, Homo sapiens
gagagcugucugguucuggu

SEQ ID NO: 5684 - RNA, 20 nt, Homo sapiens
cucugagagcugucugguuc

SEQ ID NO: 5685 - RNA, 20 nt, Homo sapiens
ggguugcucugagagcuguc

SEQ ID NO: 5686 - RNA, 20 nt, Homo sapiens
gaaaaacguguucccaccca

SEQ ID NO: 5687 - RNA, 20 nt, Homo sapiens
aggcuucuaccccgaccacg

SEQ ID NO: 5688 - RNA, 20 nt, Homo sapiens
ccgaccacguggagcugagc

SEQ ID NO: 5689 - RNA, 20 nt, Homo sapiens
cacagacccgcagccccuca

SEQ ID NO: 5690 - RNA, 20 nt, Homo sapiens
ugggugggaacacguuuuuc

SEQ ID NO: 5691 - RNA, 20 nt, Homo sapiens
caaacacagcgaccuugggu

SEQ ID NO: 5692 - RNA, 20 nt, Homo sapiens
ucaaacacagcgaccuuggg

SEQ ID NO: 5693 - RNA, 20 nt, Homo sapiens
ggcucaaacacagcgaccuu

SEQ ID NO: 5694 - RNA, 20 nt, Homo sapiens
uggcucaaacacagcgaccu

SEQ ID NO: 5695 - RNA, 20 nt, Homo sapiens
cgggguagaagccuguggcc

SEQ ID NO: 5696 - RNA, 20 nt, Homo sapiens
guggucgggguagaagccug

SEQ ID NO: 5697 - RNA, 20 nt, Homo sapiens
agcucagcuccacguggucg

SEQ ID NO: 5698 - RNA, 20 nt, Homo sapiens
cagcucagcuccacgugguc

SEQ ID NO: 5699 - RNA, 20 nt, Homo sapiens
ccagcucagcuccacguggu

SEQ ID NO: 5700 - RNA, 20 nt, Homo sapiens
gacagguuuggcccuauccu

SEQ ID NO: 5701 - RNA, 20 nt, Homo sapiens
ugacagguuuggcccuaucc

SEQ ID NO: 5702 - RNA, 20 nt, Homo sapiens
gacgaucugggugacagguu

SEQ ID NO: 5703 - RNA, 20 nt, Homo sapiens
gcgcugacgaucugggugac

SEQ ID NO: 5704 - RNA, 20 nt, Homo sapiens
cccuguuuucuuucagacug

SEQ ID NO: 5705 - RNA, 20 nt, Homo sapiens
aggagagacucacuuaccgg

SEQ ID NO: 5706 - RNA, 20 nt, Homo sapiens
aaaaggagagacucacuuac

SEQ ID NO: 5707 - RNA, 20 nt, Homo sapiens
ucaacagagucuuaccagca

SEQ ID NO: 5708 - RNA, 20 nt, Homo sapiens
caacagagucuuaccagcaa

SEQ ID NO: 5709 - RNA, 20 nt, Homo sapiens
aacagagucuuaccagcaag

SEQ ID NO: 5710 - RNA, 20 nt, Homo sapiens
auccucuaugagaucuugcu

SEQ ID NO: 5711 - RNA, 20 nt, Homo sapiens
uccucuaugagaucuugcua

SEQ ID NO: 5712 - RNA, 20 nt, Homo sapiens
cuaugagaucuugcuaggga

SEQ ID NO: 5713 - RNA, 20 nt, Homo sapiens
ggccaccuuguaugccgugc

SEQ ID NO: 5714 - RNA, 20 nt, Homo sapiens
ggucagugcccucgugcuga

SEQ ID NO: 5715 - RNA, 20 nt, Homo sapiens
uggcagacaggaccccuugc

SEQ ID NO: 5716 - RNA, 20 nt, Homo sapiens
cauagaggaugguggcagac

SEQ ID NO: 5717 - RNA, 20 nt, Homo sapiens
caagaucucauagaggaugg

SEQ ID NO: 5718 - RNA, 20 nt, Homo sapiens
uagcaagaucucauagagga

SEQ ID NO: 5719 - RNA, 20 nt, Homo sapiens
ucccuagcaagaucucauag

SEQ ID NO: 5720 - RNA, 20 nt, Homo sapiens
ucaggcggaggugagcggaa

SEQ ID NO: 5721 - RNA, 20 nt, Homo sapiens
cucaggcggaggugagcgga

SEQ ID NO: 5722 - RNA, 20 nt, Homo sapiens
acugcucaggcggaggugag

SEQ ID NO: 5723 - RNA, 20 nt, Homo sapiens
gcucaccuccgccugagcag

SEQ ID NO: 5724 - RNA, 20 nt, Homo sapiens
cuucuccacugcucaggcgg

SEQ ID NO: 5725 - RNA, 20 nt, Homo sapiens
caguggagaaggcggcacuc

SEQ ID NO: 5726 - RNA, 20 nt, Homo sapiens
uggagaaggcggcacucugg

SEQ ID NO: 5727 - RNA, 20 nt, Homo sapiens
ggagaaggcggcacucuggu

SEQ ID NO: 5728 - RNA, 20 nt, Homo sapiens
gagaaggcggcacucuggug

SEQ ID NO: 5729 - RNA, 20 nt, Homo sapiens
aggcgcccuggccagucguc

SEQ ID NO: 5730 - RNA, 20 nt, Homo sapiens
ggcgcccuggccagucgucu

SEQ ID NO: 5731 - RNA, 20 nt, Homo sapiens
gcccuggccagucgucuggg

SEQ ID NO: 5732 - RNA, 20 nt, Homo sapiens
caccgcccagacgacuggcc

SEQ ID NO: 5733 - RNA, 20 nt, Homo sapiens
uguagcaccgcccagacgac

SEQ ID NO: 5734 - RNA, 20 nt, Homo sapiens
cgucugggcggugcuacaac

SEQ ID NO: 5735 - RNA, 20 nt, Homo sapiens
gucugggcggugcuacaacu

SEQ ID NO: 5736 - RNA, 20 nt, Homo sapiens
gggcggugcuacaacugggc

SEQ ID NO: 5737 - RNA, 20 nt, Homo sapiens
cggugcuacaacugggcugg

SEQ ID NO: 5738 - RNA, 20 nt, Homo sapiens
caccuaccuaagaaccaucc

SEQ ID NO: 5739 - RNA, 20 nt, Homo sapiens
gagaagguggggggguucca

SEQ ID NO: 5740 - RNA, 20 nt, Homo sapiens
cggucaccacgagcagggcu

SEQ ID NO: 5741 - RNA, 20 nt, Homo sapiens
ucggucaccacgagcagggc

SEQ ID NO: 5742 - RNA, 20 nt, Homo sapiens
gcccugcucguggugaccga

SEQ ID NO: 5743 - RNA, 20 nt, Homo sapiens
cccuucggucaccacgagca

SEQ ID NO: 5744 - RNA, 20 nt, Homo sapiens
cccugcucguggugaccgaa

SEQ ID NO: 5745 - RNA, 20 nt, Homo sapiens
ccccuucggucaccacgagc

SEQ ID NO: 5746 - RNA, 20 nt, Homo sapiens
ccugcucguggugaccgaag

SEQ ID NO: 5747 - RNA, 20 nt, Homo sapiens
gaagguggcguuguccccuu

SEQ ID NO: 5748 - RNA, 20 nt, Homo sapiens
guuggagaagcugcagguga

SEQ ID NO: 5749 - RNA, 20 nt, Homo sapiens
cacgaagcucuccgaugugu

SEQ ID NO: 5750 - RNA, 20 nt, Homo sapiens
cggagagcuucgugcuaaac

SEQ ID NO: 5751 - RNA, 20 nt, Homo sapiens
ucugguugcuggggcucaug

SEQ ID NO: 5752 - RNA, 20 nt, Homo sapiens
gcuuguccgucugguugcug

SEQ ID NO: 5753 - RNA, 20 nt, Homo sapiens
agcuuguccgucugguugcu

SEQ ID NO: 5754 - RNA, 20 nt, Homo sapiens
cagcuuguccgucugguugc

SEQ ID NO: 5755 - RNA, 20 nt, Homo sapiens
cagcaaccagacggacaagc

SEQ ID NO: 5756 - RNA, 20 nt, Homo sapiens
aggcggccagcuuguccguc

SEQ ID NO: 5757 - RNA, 20 nt, Homo sapiens
cuggcugcgguccucgggga

SEQ ID NO: 5758 - RNA, 20 nt, Homo sapiens
cgggcuggcugcgguccucg

SEQ ID NO: 5759 - RNA, 20 nt, Homo sapiens
ccgggcuggcugcgguccuc

SEQ ID NO: 5760 - RNA, 20 nt, Homo sapiens
cccgaggaccgcagccagcc

SEQ ID NO: 5761 - RNA, 20 nt, Homo sapiens
gccgggcuggcugcgguccu

SEQ ID NO: 5762 - RNA, 20 nt, Homo sapiens
cggaagcggcaguccuggcc

SEQ ID NO: 5763 - RNA, 20 nt, Homo sapiens
acggaagcggcaguccuggc

SEQ ID NO: 5764 - RNA, 20 nt, Homo sapiens
ugacacggaagcggcagucc

SEQ ID NO: 5765 - RNA, 20 nt, Homo sapiens
gcaguugugugacacggaag

SEQ ID NO: 5766 - RNA, 20 nt, Homo sapiens
cgugucacacaacugcccaa

SEQ ID NO: 5767 - RNA, 20 nt, Homo sapiens
gugucacacaacugcccaac

SEQ ID NO: 5768 - RNA, 20 nt, Homo sapiens
auguggaagucacgcccguu

SEQ ID NO: 5769 - RNA, 20 nt, Homo sapiens
cauguggaagucacgcccgu

SEQ ID NO: 5770 - RNA, 20 nt, Homo sapiens
gcgugacuuccacaugagcg

SEQ ID NO: 5771 - RNA, 20 nt, Homo sapiens
acuuccacaugagcgugguc

SEQ ID NO: 5772 - RNA, 20 nt, Homo sapiens
cuuccacaugagcgugguca

SEQ ID NO: 5773 - RNA, 20 nt, Homo sapiens
gggcccugaccacgcucaug

SEQ ID NO: 5774 - RNA, 20 nt, Homo sapiens
acaugagcguggucagggcc

SEQ ID NO: 5775 - RNA, 20 nt, Homo sapiens
agggcccggcgcaaugacag

SEQ ID NO: 5776 - RNA, 20 nt, Homo sapiens
ggugccgcugucauugcgcc

SEQ ID NO: 5777 - RNA, 20 nt, Homo sapiens
aggugccgcugucauugcgc

SEQ ID NO: 5778 - RNA, 20 nt, Homo sapiens
gacagcggcaccuaccucug

SEQ ID NO: 5779 - RNA, 20 nt, Homo sapiens
acagcggcaccuaccucugu

SEQ ID NO: 5780 - RNA, 20 nt, Homo sapiens
ccagggagauggccccacag

SEQ ID NO: 5781 - RNA, 20 nt, Homo sapiens
gaucugcgccuugggggcca

SEQ ID NO: 5782 - RNA, 20 nt, Homo sapiens
ugaucugcgccuugggggcc

SEQ ID NO: 5783 - RNA, 20 nt, Homo sapiens
cucuuugaucugcgccuugg

SEQ ID NO: 5784 - RNA, 20 nt, Homo sapiens
ucucuuugaucugcgccuug

SEQ ID NO: 5785 - RNA, 20 nt, Homo sapiens
cucucuuugaucugcgccuu

SEQ ID NO: 5786 - RNA, 20 nt, Homo sapiens
gcucucuuugaucugcgccu

SEQ ID NO: 5787 - RNA, 20 nt, Homo sapiens
cgcagaucaaagagagccug

SEQ ID NO: 5788 - RNA, 20 nt, Homo sapiens
gcagaucaaagagagccugc

SEQ ID NO: 5789 - RNA, 20 nt, Homo sapiens
agagccugcgggcagagcuc

SEQ ID NO: 5790 - RNA, 20 nt, Homo sapiens
aggguuuggaacuggccggc

SEQ ID NO: 5791 - RNA, 20 nt, Homo sapiens
caccaggguuuggaacuggc

SEQ ID NO: 5792 - RNA, 20 nt, Homo sapiens
cggccaguuccaaacccugg

SEQ ID NO: 5793 - RNA, 20 nt, Homo sapiens
caaccaccaggguuuggaac

SEQ ID NO: 5794 - RNA, 20 nt, Homo sapiens
caguuccaaacccugguggu

SEQ ID NO: 5795 - RNA, 20 nt, Homo sapiens
cgacaccaaccaccaggguu

SEQ ID NO: 5796 - RNA, 20 nt, Homo sapiens
aacccuggugguuggugucg

SEQ ID NO: 5797 - RNA, 20 nt, Homo sapiens
acccuggugguuggugucgu

SEQ ID NO: 5798 - RNA, 20 nt, Homo sapiens
gcccacgacaccaaccacca

SEQ ID NO: 5799 - RNA, 20 nt, Homo sapiens
cgcccacgacaccaaccacc

SEQ ID NO: 5800 - RNA, 20 nt, Homo sapiens
cuggugguuggugucguggg

SEQ ID NO: 5801 - RNA, 20 nt, Homo sapiens
uggugucgugggcggccugc

SEQ ID NO: 5802 - RNA, 20 nt, Homo sapiens
ggugucgugggcggccugcu

SEQ ID NO: 5803 - RNA, 20 nt, Homo sapiens
ggugcugcuagucugggucc

SEQ ID NO: 5804 - RNA, 20 nt, Homo sapiens
uccuggccgucaucugcucc

SEQ ID NO: 5805 - RNA, 20 nt, Homo sapiens
cccgggagcagaugacggcc

SEQ ID NO: 5806 - RNA, 20 nt, Homo sapiens
ccuggccgucaucugcuccc

SEQ ID NO: 5807 - RNA, 20 nt, Homo sapiens
gacguuaccucgugcggccc

SEQ ID NO: 5808 - RNA, 20 nt, Homo sapiens
ugacguuaccucgugcggcc

SEQ ID NO: 5809 - RNA, 20 nt, Homo sapiens
ugggaugacguuaccucgug

SEQ ID NO: 5810 - RNA, 20 nt, Homo sapiens
cugcagggacaauaggagcc

SEQ ID NO: 5811 - RNA, 20 nt, Homo sapiens
acaauaggagccaggcgcac

SEQ ID NO: 5812 - RNA, 20 nt, Homo sapiens
caggggcuggccggugcgcc

SEQ ID NO: 5813 - RNA, 20 nt, Homo sapiens
aaaagagugagacucaccag

SEQ ID NO: 5814 - RNA, 20 nt, Homo sapiens
gaaaagagugagacucacca

SEQ ID NO: 5815 - RNA, 20 nt, Homo sapiens
ggaaaagagugagacucacc

SEQ ID NO: 5816 - RNA, 25 nt, Homo sapiens
ucucaaacaaaugugucacaaagua

SEQ ID NO: 5817 - RNA, 25 nt, Homo sapiens
cacagacaaaacugugcuagacaug

SEQ ID NO: 5818 - RNA, 25 nt, Homo sapiens
aaaacugugcuagacaugaggucua

SEQ ID NO: 5819 - RNA, 25 nt, Homo sapiens
auggacuucaagagcaacagugcug

SEQ ID NO: 5820 - RNA, 25 nt, Homo sapiens
cuucaagagcaacagugcuguggcc

SEQ ID NO: 5821 - RNA, 25 nt, Homo sapiens
cugggcuggggaagaaggugucuuc

SEQ ID NO: 5822 - RNA, 25 nt, Homo sapiens
ucuucuggaauaaugcuguuguuga

SEQ ID NO: 5823 - RNA, 25 nt, Homo sapiens
caugcaaagucagauuuguugcucc

SEQ ID NO: 5824 - RNA, 25 nt, Homo sapiens
gacacauuuguuugagaaucaaaau

SEQ ID NO: 5825 - RNA, 25 nt, Homo sapiens
uguuugagaaucaaaaucggugaau

SEQ ID NO: 5826 - RNA, 25 nt, Homo sapiens
gugaauaggcagacagacuugucac

SEQ ID NO: 5827 - RNA, 25 nt, Homo sapiens
gucacuggauuuagagucucucagc

SEQ ID NO: 5828 - RNA, 25 nt, Homo sapiens
gauuuagagucucucagcugguaca

SEQ ID NO: 5829 - RNA, 25 nt, Homo sapiens
uagagucucucagcugguacacggc

SEQ ID NO: 5830 - RNA, 25 nt, Homo sapiens
agagucucucagcugguacacggca

SEQ ID NO: 5831 - RNA, 25 nt, Homo sapiens
cucucagcugguacacggcaggguc

SEQ ID NO: 5832 - RNA, 25 nt, Homo sapiens
ucucagcugguacacggcaggguca

SEQ ID NO: 5833 - RNA, 25 nt, Homo sapiens
cugguacacggcagggucaggguuc

SEQ ID NO: 5834 - RNA, 25 nt, Homo sapiens
gcagggucaggguucuggauaucug

SEQ ID NO: 5835 - RNA, 25 nt, Homo sapiens
cagggucaggguucuggauaucugu

SEQ ID NO: 5836 - RNA, 25 nt, Homo sapiens
ggguucuggauaucugugggacaag

SEQ ID NO: 5837 - RNA, 25 nt, Homo sapiens
uggauaucugugggacaagaggauc

SEQ ID NO: 5838 - RNA, 25 nt, Homo sapiens
ggauaucugugggacaagaggauca

SEQ ID NO: 5839 - RNA, 25 nt, Homo sapiens
ucugugggacaagaggaucaggguu

SEQ ID NO: 5840 - RNA, 25 nt, Homo sapiens
uuagaaaguuccugugaugucaagc

SEQ ID NO: 5841 - RNA, 25 nt, Homo sapiens
agcuggucgagaaaagcuuugaaac

SEQ ID NO: 5842 - RNA, 25 nt, Homo sapiens
agaaaagcuuugaaacagguaagac

SEQ ID NO: 5843 - RNA, 25 nt, Homo sapiens
gaaaagcuuugaaacagguaagaca

SEQ ID NO: 5844 - RNA, 25 nt, Homo sapiens
aaaagcuuugaaacagguaagacag

SEQ ID NO: 5845 - RNA, 25 nt, Homo sapiens
aaacagguaagacaggggucuagcc

SEQ ID NO: 5846 - RNA, 25 nt, Homo sapiens
aacagguaagacaggggucuagccu

SEQ ID NO: 5847 - RNA, 25 nt, Homo sapiens
cuuuucucgaccagcuugacaucac

SEQ ID NO: 5848 - RNA, 25 nt, Homo sapiens
cuugacaucacaggaacuuucuaaa

SEQ ID NO: 5849 - RNA, 25 nt, Homo sapiens
uaaacuuucaaaaccugucagugau

SEQ ID NO: 5850 - RNA, 25 nt, Homo sapiens
aaacuuucaaaaccugucagugauu

SEQ ID NO: 5851 - RNA, 25 nt, Homo sapiens
ggguuccgaauccuccuccugaaag

SEQ ID NO: 5852 - RNA, 25 nt, Homo sapiens
uccgaauccuccuccugaaaguggc

SEQ ID NO: 5853 - RNA, 25 nt, Homo sapiens
ccgaauccuccuccugaaaguggcc

SEQ ID NO: 5854 - RNA, 25 nt, Homo sapiens
cggguuuaaucugcucaugacgcug

SEQ ID NO: 5855 - RNA, 25 nt, Homo sapiens
uaaucugcucaugacgcugcggcug

SEQ ID NO: 5856 - RNA, 25 nt, Homo sapiens
ugacgcugcggcugugguccagcug

SEQ ID NO: 5857 - RNA, 25 nt, Homo sapiens
cugcggcugugguccagcugaggug

SEQ ID NO: 5858 - RNA, 25 nt, Homo sapiens
ugcggcugugguccagcugagguga

SEQ ID NO: 5859 - RNA, 25 nt, Homo sapiens
gcggcugugguccagcugaggugag

SEQ ID NO: 5860 - RNA, 25 nt, Homo sapiens
cagcugaggugaggggccuugaagc

SEQ ID NO: 5861 - RNA, 25 nt, Homo sapiens
agcugaggugaggggccuugaagcu

SEQ ID NO: 5862 - RNA, 25 nt, Homo sapiens
cagcuucaaggccccucaccucagc

SEQ ID NO: 5863 - RNA, 25 nt, Homo sapiens
cgcagcgucaugagcagauuaaacc

SEQ ID NO: 5864 - RNA, 25 nt, Homo sapiens
gagcagauuaaacccggccacuuuc

SEQ ID NO: 5865 - RNA, 25 nt, Homo sapiens
cagauuaaacccggccacuuucagg

SEQ ID NO: 5866 - RNA, 25 nt, Homo sapiens
auuaaacccggccacuuucaggagg

SEQ ID NO: 5867 - RNA, 25 nt, Homo sapiens
cccggccacuuucaggaggaggauu

SEQ ID NO: 5868 - RNA, 25 nt, Homo sapiens
gaggauucggaacccaaucacugac

SEQ ID NO: 5869 - RNA, 25 nt, Homo sapiens
aaucacugacagguuuugaaaguuu

SEQ ID NO: 5870 - RNA, 25 nt, Homo sapiens
uuagguucguaucuguaaaaccaag

SEQ ID NO: 5871 - RNA, 25 nt, Homo sapiens
uaucuguaaaaccaagaggccacag

SEQ ID NO: 5872 - RNA, 25 nt, Homo sapiens
gccccucuucucccucuccaaacag

SEQ ID NO: 5873 - RNA, 25 nt, Homo sapiens
ccccucuucucccucuccaaacaga

SEQ ID NO: 5874 - RNA, 25 nt, Homo sapiens
aacagagggaacucuccuaccccca

SEQ ID NO: 5875 - RNA, 25 nt, Homo sapiens
agagggaacucuccuacccccaagg

SEQ ID NO: 5876 - RNA, 25 nt, Homo sapiens
agcugcuaccaccucugugcccccc

SEQ ID NO: 5877 - RNA, 25 nt, Homo sapiens
gugcccccccggcaaugccaccaac

SEQ ID NO: 5878 - RNA, 25 nt, Homo sapiens
gcugcuugucacugccugacauuca

SEQ ID NO: 5879 - RNA, 25 nt, Homo sapiens
ugucacugccugacauucacggcag

SEQ ID NO: 5880 - RNA, 25 nt, Homo sapiens
cugccugacauucacggcagaggca

SEQ ID NO: 5881 - RNA, 25 nt, Homo sapiens
gaggcaaggcugcugcagccucccc

SEQ ID NO: 5882 - RNA, 25 nt, Homo sapiens
acugccuccgccaucccacagauga

SEQ ID NO: 5883 - RNA, 25 nt, Homo sapiens
caucccacagaugauggaucuucag

SEQ ID NO: 5884 - RNA, 25 nt, Homo sapiens
aucccacagaugauggaucuucagu

SEQ ID NO: 5885 - RNA, 25 nt, Homo sapiens
augauggaucuucaguggguucucu

SEQ ID NO: 5886 - RNA, 25 nt, Homo sapiens
ugauggaucuucaguggguucucuu

SEQ ID NO: 5887 - RNA, 25 nt, Homo sapiens
ucuucaguggguucucuugggcucu

SEQ ID NO: 5888 - RNA, 25 nt, Homo sapiens
gcucuagguccugcagaauguugug

SEQ ID NO: 5889 - RNA, 25 nt, Homo sapiens
cucuagguccugcagaauguuguga

SEQ ID NO: 5890 - RNA, 25 nt, Homo sapiens
ucuagguccugcagaauguugugag

SEQ ID NO: 5891 - RNA, 25 nt, Homo sapiens
acauaguauucuucuucucaagacg

SEQ ID NO: 5892 - RNA, 25 nt, Homo sapiens
cauaguauucuucuucucaagacgu

SEQ ID NO: 5893 - RNA, 25 nt, Homo sapiens
auaguauucuucuucucaagacgug

SEQ ID NO: 5894 - RNA, 25 nt, Homo sapiens
uaguauucuucuucucaagacgugg

SEQ ID NO: 5895 - RNA, 25 nt, Homo sapiens
aguauucuucuucucaagacguggg

SEQ ID NO: 5896 - RNA, 25 nt, Homo sapiens
guggggggaaauuaucucauuaucg

SEQ ID NO: 5897 - RNA, 25 nt, Homo sapiens
ucgaggcccugcuaugcuguguauc

SEQ ID NO: 5898 - RNA, 25 nt, Homo sapiens
cgaggcccugcuaugcuguguaucu

SEQ ID NO: 5899 - RNA, 25 nt, Homo sapiens
ugccgaugccuucauuaaaaugauu

SEQ ID NO: 5900 - RNA, 25 nt, Homo sapiens
agcagagacugugccucuguuugac

SEQ ID NO: 5901 - RNA, 25 nt, Homo sapiens
gcagagacugugccucuguuugacu

SEQ ID NO: 5902 - RNA, 25 nt, Homo sapiens
gacugugccucuguuugacuggguu

SEQ ID NO: 5903 - RNA, 25 nt, Homo sapiens
gugccucuguuugacuggguuuggu

SEQ ID NO: 5904 - RNA, 25 nt, Homo sapiens
acuccuaccaaacccagucaaacag

SEQ ID NO: 5905 - RNA, 25 nt, Homo sapiens
cugcucuuccaaaucauuuuaauga

SEQ ID NO: 5906 - RNA, 25 nt, Homo sapiens
uuccaaaucauuuuaaugaaggcau

SEQ ID NO: 5907 - RNA, 25 nt, Homo sapiens
ucauuuuaaugaaggcaucggcagc

SEQ ID NO: 5908 - RNA, 25 nt, Homo sapiens
aacacgcccagauacacagcauagc

SEQ ID NO: 5909 - RNA, 25 nt, Homo sapiens
acacgcccagauacacagcauagca

SEQ ID NO: 5910 - RNA, 25 nt, Homo sapiens
aaauaaaccccucacaacauucugc

SEQ ID NO: 5911 - RNA, 25 nt, Homo sapiens
gaacccacugaagauccaucaucug

SEQ ID NO: 5912 - RNA, 25 nt, Homo sapiens
aacccacugaagauccaucaucugu

SEQ ID NO: 5913 - RNA, 25 nt, Homo sapiens
cacugaagauccaucaucuguggga

SEQ ID NO: 5914 - RNA, 25 nt, Homo sapiens
ugaagauccaucaucugugggaugg

SEQ ID NO: 5915 - RNA, 25 nt, Homo sapiens
agauccaucaucugugggauggcgg

SEQ ID NO: 5916 - RNA, 25 nt, Homo sapiens
ucugugggauggcggaggcagucuc

SEQ ID NO: 5917 - RNA, 25 nt, Homo sapiens
cugugggauggcggaggcagucucu

SEQ ID NO: 5918 - RNA, 25 nt, Homo sapiens
ugugggauggcggaggcagucucug

SEQ ID NO: 5919 - RNA, 25 nt, Homo sapiens
auggcggaggcagucucuggggagc

SEQ ID NO: 5920 - RNA, 25 nt, Homo sapiens
gcggaggcagucucuggggagcagg

SEQ ID NO: 5921 - RNA, 25 nt, Homo sapiens
cggaggcagucucuggggagcagga

SEQ ID NO: 5922 - RNA, 25 nt, Homo sapiens
ggagcaggagggaaugugcacagcc

SEQ ID NO: 5923 - RNA, 25 nt, Homo sapiens
gagcaggagggaaugugcacagcca

SEQ ID NO: 5924 - RNA, 25 nt, Homo sapiens
agcaggagggaaugugcacagccag

SEQ ID NO: 5925 - RNA, 25 nt, Homo sapiens
aggagggaaugugcacagccagggg

SEQ ID NO: 5926 - RNA, 25 nt, Homo sapiens
cagccuugccucugccgugaauguc

SEQ ID NO: 5927 - RNA, 25 nt, Homo sapiens
ugucaggcagugacaagcagcaaua

SEQ ID NO: 5928 - RNA, 25 nt, Homo sapiens
gucaggcagugacaagcagcaauaa

SEQ ID NO: 5929 - RNA, 25 nt, Homo sapiens
gugacaagcagcaauaagggaacag

SEQ ID NO: 5930 - RNA, 25 nt, Homo sapiens
ugacaagcagcaauaagggaacaga

SEQ ID NO: 5931 - RNA, 25 nt, Homo sapiens
gacaagcagcaauaagggaacagag

SEQ ID NO: 5932 - RNA, 25 nt, Homo sapiens
acaagcagcaauaagggaacagagg

SEQ ID NO: 5933 - RNA, 25 nt, Homo sapiens
agcagcaauaagggaacagaggggg

SEQ ID NO: 5934 - RNA, 25 nt, Homo sapiens
gaacagaggggguggcagcaguguu

SEQ ID NO: 5935 - RNA, 25 nt, Homo sapiens
ucuucagcaaucuuaaucauaaauu

SEQ ID NO: 5936 - RNA, 25 nt, Homo sapiens
cuucagcaaucuuaaucauaaauuc

SEQ ID NO: 5937 - RNA, 25 nt, Homo sapiens
agcaaucuuaaucauaaauucgggu

SEQ ID NO: 5938 - RNA, 25 nt, Homo sapiens
aucauaaauucggguaggauccagu

SEQ ID NO: 5939 - RNA, 25 nt, Homo sapiens
auaaauucggguaggauccaguugg

SEQ ID NO: 5940 - RNA, 25 nt, Homo sapiens
gguaggauccaguugguggcauugc

SEQ ID NO: 5941 - RNA, 25 nt, Homo sapiens
guaggauccaguugguggcauugcc

SEQ ID NO: 5942 - RNA, 25 nt, Homo sapiens
uaggauccaguugguggcauugccg

SEQ ID NO: 5943 - RNA, 25 nt, Homo sapiens
aggauccaguugguggcauugccgg

SEQ ID NO: 5944 - RNA, 25 nt, Homo sapiens
ggauccaguugguggcauugccggg

SEQ ID NO: 5945 - RNA, 25 nt, Homo sapiens
gauccaguugguggcauugccgggg

SEQ ID NO: 5946 - RNA, 25 nt, Homo sapiens
ugguggcauugccgggggggcacag

SEQ ID NO: 5947 - RNA, 25 nt, Homo sapiens
uggcauugccgggggggcacagagg

SEQ ID NO: 5948 - RNA, 25 nt, Homo sapiens
gaggugguagcagcuuucaccuccu

SEQ ID NO: 5949 - RNA, 25 nt, Homo sapiens
aggugguagcagcuuucaccuccuu

SEQ ID NO: 5950 - RNA, 25 nt, Homo sapiens
ggugguagcagcuuucaccuccuug

SEQ ID NO: 5951 - RNA, 25 nt, Homo sapiens
gugguagcagcuuucaccuccuugg

SEQ ID NO: 5952 - RNA, 25 nt, Homo sapiens
uagcagcuuucaccuccuugggggu

SEQ ID NO: 5953 - RNA, 25 nt, Homo sapiens
uggggguaggagaguucccucuguu

SEQ ID NO: 5954 - RNA, 25 nt, Homo sapiens
guaggagaguucccucuguuuggag

SEQ ID NO: 5955 - RNA, 25 nt, Homo sapiens
uaggagaguucccucuguuuggaga

SEQ ID NO: 5956 - RNA, 25 nt, Homo sapiens
uucccucuguuuggagagggagaag

SEQ ID NO: 5957 - RNA, 25 nt, Homo sapiens
ucccucuguuuggagagggagaaga

SEQ ID NO: 5958 - RNA, 25 nt, Homo sapiens
cccucuguuuggagagggagaagag

SEQ ID NO: 5959 - RNA, 25 nt, Homo sapiens
gagagggagaagaggggcaaugcag

SEQ ID NO: 5960 - RNA, 25 nt, Homo sapiens
gggagaagaggggcaaugcagagga

SEQ ID NO: 5961 - RNA, 25 nt, Homo sapiens
gaggggcaaugcagaggaaggagcg

SEQ ID NO: 5962 - RNA, 25 nt, Homo sapiens
aggggcaaugcagaggaaggagcga

SEQ ID NO: 5963 - RNA, 25 nt, Homo sapiens
ugcagaggaaggagcgagggagcac

SEQ ID NO: 5964 - RNA, 25 nt, Homo sapiens
aggcugucuuacaaucuugcagauc

SEQ ID NO: 5965 - RNA, 25 nt, Homo sapiens
cuuacaaucuugcagaucuggaaug

SEQ ID NO: 5966 - RNA, 25 nt, Homo sapiens
cuucccuuuccagaggaccugaaca

SEQ ID NO: 5967 - RNA, 25 nt, Homo sapiens
gaccugaacaagguguucccacccg

SEQ ID NO: 5968 - RNA, 25 nt, Homo sapiens
gaagcagagaucucccacacccaaa

SEQ ID NO: 5969 - RNA, 25 nt, Homo sapiens
aucucccacacccaaaaggccacac

SEQ ID NO: 5970 - RNA, 25 nt, Homo sapiens
acccaaaaggccacacuggugugcc

SEQ ID NO: 5971 - RNA, 25 nt, Homo sapiens
aggccacacuggugugccuggccac

SEQ ID NO: 5972 - RNA, 25 nt, Homo sapiens
gccacaggcuucuuccccgaccacg

SEQ ID NO: 5973 - RNA, 25 nt, Homo sapiens
cuuccccgaccacguggagcugagc

SEQ ID NO: 5974 - RNA, 25 nt, Homo sapiens
ccccgaccacguggagcugagcugg

SEQ ID NO: 5975 - RNA, 25 nt, Homo sapiens
cccgaccacguggagcugagcuggu

SEQ ID NO: 5976 - RNA, 25 nt, Homo sapiens
acguggagcugagcuggugggugaa

SEQ ID NO: 5977 - RNA, 25 nt, Homo sapiens
cguggagcugagcuggugggugaau

SEQ ID NO: 5978 - RNA, 25 nt, Homo sapiens
gagcugagcuggugggugaauggga

SEQ ID NO: 5979 - RNA, 25 nt, Homo sapiens
cugagcuggugggugaaugggaagg

SEQ ID NO: 5980 - RNA, 25 nt, Homo sapiens
gggugaaugggaaggaggugcacag

SEQ ID NO: 5981 - RNA, 25 nt, Homo sapiens
ggugaaugggaaggaggugcacagu

SEQ ID NO: 5982 - RNA, 25 nt, Homo sapiens
gugaaugggaaggaggugcacagug

SEQ ID NO: 5983 - RNA, 25 nt, Homo sapiens
gucagcacagacccgcagccccuca

SEQ ID NO: 5984 - RNA, 25 nt, Homo sapiens
cagauacugccugagcagccgccug

SEQ ID NO: 5985 - RNA, 25 nt, Homo sapiens
agauacugccugagcagccgccuga

SEQ ID NO: 5986 - RNA, 25 nt, Homo sapiens
ugccugagcagccgccugagggucu

SEQ ID NO: 5987 - RNA, 25 nt, Homo sapiens
ccgccugagggucucggccaccuuc

SEQ ID NO: 5988 - RNA, 25 nt, Homo sapiens
acuuccgcugucaaguccaguucua

SEQ ID NO: 5989 - RNA, 25 nt, Homo sapiens
cuuccgcugucaaguccaguucuac

SEQ ID NO: 5990 - RNA, 25 nt, Homo sapiens
ugucaaguccaguucuacgggcucu

SEQ ID NO: 5991 - RNA, 25 nt, Homo sapiens
cuacgggcucucggagaaugacgag

SEQ ID NO: 5992 - RNA, 25 nt, Homo sapiens
cucucggagaaugacgaguggaccc

SEQ ID NO: 5993 - RNA, 25 nt, Homo sapiens
ggagaaugacgaguggacccaggau

SEQ ID NO: 5994 - RNA, 25 nt, Homo sapiens
gagaaugacgaguggacccaggaua

SEQ ID NO: 5995 - RNA, 25 nt, Homo sapiens
cccgucacccagaucgucagcgccg

SEQ ID NO: 5996 - RNA, 25 nt, Homo sapiens
cacccagaucgucagcgccgaggcc

SEQ ID NO: 5997 - RNA, 25 nt, Homo sapiens
acccagaucgucagcgccgaggccu

SEQ ID NO: 5998 - RNA, 25 nt, Homo sapiens
cccagaucgucagcgccgaggccug

SEQ ID NO: 5999 - RNA, 25 nt, Homo sapiens
ucagcgccgaggccugggguagagc

SEQ ID NO: 6000 - RNA, 25 nt, Homo sapiens
cgaggccugggguagagcaggugag

SEQ ID NO: 6001 - RNA, 25 nt, Homo sapiens
gaggccugggguagagcaggugagu

SEQ ID NO: 6002 - RNA, 25 nt, Homo sapiens
aggccugggguagagcaggugagug

SEQ ID NO: 6003 - RNA, 25 nt, Homo sapiens
ugggguagagcaggugaguggggcc

SEQ ID NO: 6004 - RNA, 25 nt, Homo sapiens
gggguagagcaggugaguggggccu

SEQ ID NO: 6005 - RNA, 25 nt, Homo sapiens
ggguagagcaggugaguggggccug

SEQ ID NO: 6006 - RNA, 25 nt, Homo sapiens
aggccccacucaccugcucuacccc

SEQ ID NO: 6007 - RNA, 25 nt, Homo sapiens
cacucaccugcucuaccccaggccu

SEQ ID NO: 6008 - RNA, 25 nt, Homo sapiens
accccaggccucggcgcugacgauc

SEQ ID NO: 6009 - RNA, 25 nt, Homo sapiens
ccccaggccucggcgcugacgaucu

SEQ ID NO: 6010 - RNA, 25 nt, Homo sapiens
gccucggcgcugacgaucuggguga

SEQ ID NO: 6011 - RNA, 25 nt, Homo sapiens
ccucggcgcugacgaucugggugac

SEQ ID NO: 6012 - RNA, 25 nt, Homo sapiens
gcgcugacgaucugggugacggguu

SEQ ID NO: 6013 - RNA, 25 nt, Homo sapiens
cugggugacggguuuggcccuaucc

SEQ ID NO: 6014 - RNA, 25 nt, Homo sapiens
ugggugacggguuuggcccuauccu

SEQ ID NO: 6015 - RNA, 25 nt, Homo sapiens
gucauucuccgagagcccguagaac

SEQ ID NO: 6016 - RNA, 25 nt, Homo sapiens
gagcccguagaacuggacuugacag

SEQ ID NO: 6017 - RNA, 25 nt, Homo sapiens
guagaacuggacuugacagcggaag

SEQ ID NO: 6018 - RNA, 25 nt, Homo sapiens
cuggacuugacagcggaagugguug

SEQ ID NO: 6019 - RNA, 25 nt, Homo sapiens
uggacuugacagcggaagugguugc

SEQ ID NO: 6020 - RNA, 25 nt, Homo sapiens
ggacuugacagcggaagugguugcg

SEQ ID NO: 6021 - RNA, 25 nt, Homo sapiens
gacuugacagcggaagugguugcgg

SEQ ID NO: 6022 - RNA, 25 nt, Homo sapiens
aagugguugcggggguucugccaga

SEQ ID NO: 6023 - RNA, 25 nt, Homo sapiens
ugguugcggggguucugccagaagg

SEQ ID NO: 6024 - RNA, 25 nt, Homo sapiens
cugccagaagguggccgagacccuc

SEQ ID NO: 6025 - RNA, 25 nt, Homo sapiens
ccagaagguggccgagacccucagg

SEQ ID NO: 6026 - RNA, 25 nt, Homo sapiens
ggccgagacccucaggcggcugcuc

SEQ ID NO: 6027 - RNA, 25 nt, Homo sapiens
cucaggcggcugcucaggcaguauc

SEQ ID NO: 6028 - RNA, 25 nt, Homo sapiens
gcucaggcaguaucuggagucauug

SEQ ID NO: 6029 - RNA, 25 nt, Homo sapiens
cucaggcaguaucuggagucauuga

SEQ ID NO: 6030 - RNA, 25 nt, Homo sapiens
aggcaguaucuggagucauugaggg

SEQ ID NO: 6031 - RNA, 25 nt, Homo sapiens
ggcaguaucuggagucauugagggc

SEQ ID NO: 6032 - RNA, 25 nt, Homo sapiens
gucauugagggcgggcugcuccuug

SEQ ID NO: 6033 - RNA, 25 nt, Homo sapiens
ucauugagggcgggcugcuccuuga

SEQ ID NO: 6034 - RNA, 25 nt, Homo sapiens
cauugagggcgggcugcuccuugag

SEQ ID NO: 6035 - RNA, 25 nt, Homo sapiens
gggcgggcugcuccuugaggggcug

SEQ ID NO: 6036 - RNA, 25 nt, Homo sapiens
ggcgggcugcuccuugaggggcugc

SEQ ID NO: 6037 - RNA, 25 nt, Homo sapiens
auucacccaccagcucagcuccacg

SEQ ID NO: 6038 - RNA, 25 nt, Homo sapiens
acccaccagcucagcuccacguggu

SEQ ID NO: 6039 - RNA, 25 nt, Homo sapiens
cccaccagcucagcuccacgugguc

SEQ ID NO: 6040 - RNA, 25 nt, Homo sapiens
ccaccagcucagcuccacguggucg

SEQ ID NO: 6041 - RNA, 25 nt, Homo sapiens
uccacguggucggggaagaagccug

SEQ ID NO: 6042 - RNA, 25 nt, Homo sapiens
guggucggggaagaagccuguggcc

SEQ ID NO: 6043 - RNA, 25 nt, Homo sapiens
aagccuguggccaggcacaccagug

SEQ ID NO: 6044 - RNA, 25 nt, Homo sapiens
ggccaggcacaccaguguggccuuu

SEQ ID NO: 6045 - RNA, 25 nt, Homo sapiens
gccaggcacaccaguguggccuuuu

SEQ ID NO: 6046 - RNA, 25 nt, Homo sapiens
gcacaccaguguggccuuuugggug

SEQ ID NO: 6047 - RNA, 25 nt, Homo sapiens
cacaccaguguggccuuuugggugu

SEQ ID NO: 6048 - RNA, 25 nt, Homo sapiens
gggugugggagaucucugcuucuga

SEQ ID NO: 6049 - RNA, 25 nt, Homo sapiens
ucugauggcucaaacacagcgaccu

SEQ ID NO: 6050 - RNA, 25 nt, Homo sapiens
cugauggcucaaacacagcgaccuc

SEQ ID NO: 6051 - RNA, 25 nt, Homo sapiens
auggcucaaacacagcgaccucggg

SEQ ID NO: 6052 - RNA, 25 nt, Homo sapiens
uggcucaaacacagcgaccucgggu

SEQ ID NO: 6053 - RNA, 25 nt, Homo sapiens
gaccucgggugggaacaccuuguuc

SEQ ID NO: 6054 - RNA, 25 nt, Homo sapiens
gugggaacaccuuguucagguccuc

SEQ ID NO: 6055 - RNA, 25 nt, Homo sapiens
aacaccuuguucagguccucuggaa

SEQ ID NO: 6056 - RNA, 25 nt, Homo sapiens
acaccuuguucagguccucuggaaa

SEQ ID NO: 6057 - RNA, 25 nt, Homo sapiens
uguucagguccucuggaaagggaag

SEQ ID NO: 6058 - RNA, 25 nt, Homo sapiens
guucagguccucuggaaagggaaga

SEQ ID NO: 6059 - RNA, 25 nt, Homo sapiens
uucagguccucuggaaagggaagag

SEQ ID NO: 6060 - RNA, 25 nt, Homo sapiens
uuucuuucagacuguggcuuuaccu

SEQ ID NO: 6061 - RNA, 25 nt, Homo sapiens
uucuuucagacuguggcuuuaccuc

SEQ ID NO: 6062 - RNA, 25 nt, Homo sapiens
guaaagccacagucugaaagaaagc

SEQ ID NO: 6063 - RNA, 25 nt, Homo sapiens
uaaagccacagucugaaagaaagca

SEQ ID NO: 6064 - RNA, 25 nt, Homo sapiens
ccgugccaacaguguccuaccagca

SEQ ID NO: 6065 - RNA, 25 nt, Homo sapiens
cgugccaacaguguccuaccagcaa

SEQ ID NO: 6066 - RNA, 25 nt, Homo sapiens
gugccaacaguguccuaccagcaag

SEQ ID NO: 6067 - RNA, 25 nt, Homo sapiens
ccaccauccucuaugagauccugcu

SEQ ID NO: 6068 - RNA, 25 nt, Homo sapiens
caccauccucuaugagauccugcua

SEQ ID NO: 6069 - RNA, 25 nt, Homo sapiens
auccucuaugagauccugcuaggga

SEQ ID NO: 6070 - RNA, 25 nt, Homo sapiens
gggaaggccacccuguaugcugugc

SEQ ID NO: 6071 - RNA, 25 nt, Homo sapiens
gugcuggucagcgcccuuguguuga

SEQ ID NO: 6072 - RNA, 25 nt, Homo sapiens
gucagcgcccuuguguugauggcca

SEQ ID NO: 6073 - RNA, 25 nt, Homo sapiens
ccuuguguugauggccaugguaagc

SEQ ID NO: 6074 - RNA, 25 nt, Homo sapiens
uguguugauggccaugguaagcagg

SEQ ID NO: 6075 - RNA, 25 nt, Homo sapiens
guguugauggccaugguaagcagga

SEQ ID NO: 6076 - RNA, 25 nt, Homo sapiens
ugauggccaugguaagcaggagggc

SEQ ID NO: 6077 - RNA, 25 nt, Homo sapiens
ggccaugguaagcaggagggcagga

SEQ ID NO: 6078 - RNA, 25 nt, Homo sapiens
gccaugguaagcaggagggcaggau

SEQ ID NO: 6079 - RNA, 25 nt, Homo sapiens
ccaugguaagcaggagggcaggaug

SEQ ID NO: 6080 - RNA, 25 nt, Homo sapiens
ccccauccugcccuccugcuuacca

SEQ ID NO: 6081 - RNA, 25 nt, Homo sapiens
ccugcuuaccauggccaucaacaca

SEQ ID NO: 6082 - RNA, 25 nt, Homo sapiens
cugcuuaccauggccaucaacacaa

SEQ ID NO: 6083 - RNA, 25 nt, Homo sapiens
aagggcgcugaccagcacagcauac

SEQ ID NO: 6084 - RNA, 25 nt, Homo sapiens
agggcgcugaccagcacagcauaca

SEQ ID NO: 6085 - RNA, 25 nt, Homo sapiens
gcgcugaccagcacagcauacaggg

SEQ ID NO: 6086 - RNA, 25 nt, Homo sapiens
agcauacaggguggccuucccuagc

SEQ ID NO: 6087 - RNA, 25 nt, Homo sapiens
ggccuucccuagcaggaucucauag

SEQ ID NO: 6088 - RNA, 25 nt, Homo sapiens
uucccuagcaggaucucauagagga

SEQ ID NO: 6089 - RNA, 25 nt, Homo sapiens
ccuagcaggaucucauagaggaugg

SEQ ID NO: 6090 - RNA, 25 nt, Homo sapiens
gaucucauagaggaugguggcagac

SEQ ID NO: 6091 - RNA, 25 nt, Homo sapiens
gaugguggcagacaggaccccuugc

SEQ ID NO: 6092 - RNA, 25 nt, Homo sapiens
guggcagacaggaccccuugcuggu

SEQ ID NO: 6093 - RNA, 25 nt, Homo sapiens
ggaccccuugcugguaggacacugu

SEQ ID NO: 6094 - RNA, 25 nt, Homo sapiens
ccuugcugguaggacacuguuggca

SEQ ID NO: 6095 - RNA, 25 nt, Homo sapiens
ugcugguaggacacuguuggcacgg

SEQ ID NO: 6096 - RNA, 25 nt, Homo sapiens
gcaggucaagagaaaggauuucuga

SEQ ID NO: 6097 - RNA, 25 nt, Homo sapiens
gagaaaggauuucugaaggcagccc

SEQ ID NO: 6098 - RNA, 25 nt, Homo sapiens
gaccugaaaaacguguucccacccg

SEQ ID NO: 6099 - RNA, 25 nt, Homo sapiens
gaagcagagaucucccacacccaaa

SEQ ID NO: 6100 - RNA, 25 nt, Homo sapiens
aucucccacacccaaaaggccacac

SEQ ID NO: 6101 - RNA, 25 nt, Homo sapiens
acccaaaaggccacacugguaugcc

SEQ ID NO: 6102 - RNA, 25 nt, Homo sapiens
aggccacacugguaugccuggccac

SEQ ID NO: 6103 - RNA, 25 nt, Homo sapiens
gccacaggcuucuaccccgaccacg

SEQ ID NO: 6104 - RNA, 25 nt, Homo sapiens
cuaccccgaccacguggagcugagc

SEQ ID NO: 6105 - RNA, 25 nt, Homo sapiens
ccccgaccacguggagcugagcugg

SEQ ID NO: 6106 - RNA, 25 nt, Homo sapiens
cccgaccacguggagcugagcuggu

SEQ ID NO: 6107 - RNA, 25 nt, Homo sapiens
acguggagcugagcuggugggugaa

SEQ ID NO: 6108 - RNA, 25 nt, Homo sapiens
cguggagcugagcuggugggugaau

SEQ ID NO: 6109 - RNA, 25 nt, Homo sapiens
gagcugagcuggugggugaauggga

SEQ ID NO: 6110 - RNA, 25 nt, Homo sapiens
cugagcuggugggugaaugggaagg

SEQ ID NO: 6111 - RNA, 25 nt, Homo sapiens
gggugaaugggaaggaggugcacag

SEQ ID NO: 6112 - RNA, 25 nt, Homo sapiens
ggugaaugggaaggaggugcacagu

SEQ ID NO: 6113 - RNA, 25 nt, Homo sapiens
gugaaugggaaggaggugcacagug

SEQ ID NO: 6114 - RNA, 25 nt, Homo sapiens
gucagcacagacccgcagccccuca

SEQ ID NO: 6115 - RNA, 25 nt, Homo sapiens
cagauacugccugagcagccgccug

SEQ ID NO: 6116 - RNA, 25 nt, Homo sapiens
agauacugccugagcagccgccuga

SEQ ID NO: 6117 - RNA, 25 nt, Homo sapiens
ugccugagcagccgccugagggucu

SEQ ID NO: 6118 - RNA, 25 nt, Homo sapiens
ccgccugagggucucggccaccuuc

SEQ ID NO: 6119 - RNA, 25 nt, Homo sapiens
acuuccgcugucaaguccaguucua

SEQ ID NO: 6120 - RNA, 25 nt, Homo sapiens
cuuccgcugucaaguccaguucuac

SEQ ID NO: 6121 - RNA, 25 nt, Homo sapiens
ugucaaguccaguucuacgggcucu

SEQ ID NO: 6122 - RNA, 25 nt, Homo sapiens
cuacgggcucucggagaaugacgag

SEQ ID NO: 6123 - RNA, 25 nt, Homo sapiens
cucucggagaaugacgaguggaccc

SEQ ID NO: 6124 - RNA, 25 nt, Homo sapiens
ggagaaugacgaguggacccaggau

SEQ ID NO: 6125 - RNA, 25 nt, Homo sapiens
gagaaugacgaguggacccaggaua

SEQ ID NO: 6126 - RNA, 25 nt, Homo sapiens
cccgucacccagaucgucagcgccg

SEQ ID NO: 6127 - RNA, 25 nt, Homo sapiens
cacccagaucgucagcgccgaggcc

SEQ ID NO: 6128 - RNA, 25 nt, Homo sapiens
acccagaucgucagcgccgaggccu

SEQ ID NO: 6129 - RNA, 25 nt, Homo sapiens
cccagaucgucagcgccgaggccug

SEQ ID NO: 6130 - RNA, 25 nt, Homo sapiens
ucagcgccgaggccugggguagagc

SEQ ID NO: 6131 - RNA, 25 nt, Homo sapiens
cgaggccugggguagagcaggugag

SEQ ID NO: 6132 - RNA, 25 nt, Homo sapiens
gaggccugggguagagcaggugagu

SEQ ID NO: 6133 - RNA, 25 nt, Homo sapiens
aggccugggguagagcaggugagug

SEQ ID NO: 6134 - RNA, 25 nt, Homo sapiens
ugggguagagcaggugaguggggcc

SEQ ID NO: 6135 - RNA, 25 nt, Homo sapiens
gggguagagcaggugaguggggccu

SEQ ID NO: 6136 - RNA, 25 nt, Homo sapiens
ggguagagcaggugaguggggccug

SEQ ID NO: 6137 - RNA, 25 nt, Homo sapiens
aggccccacucaccugcucuacccc

SEQ ID NO: 6138 - RNA, 25 nt, Homo sapiens
cacucaccugcucuaccccaggccu

SEQ ID NO: 6139 - RNA, 25 nt, Homo sapiens
accccaggccucggcgcugacgauc

SEQ ID NO: 6140 - RNA, 25 nt, Homo sapiens
ccccaggccucggcgcugacgaucu

SEQ ID NO: 6141 - RNA, 25 nt, Homo sapiens
gccucggcgcugacgaucuggguga

SEQ ID NO: 6142 - RNA, 25 nt, Homo sapiens
ccucggcgcugacgaucugggugac

SEQ ID NO: 6143 - RNA, 25 nt, Homo sapiens
gcgcugacgaucugggugacggguu

SEQ ID NO: 6144 - RNA, 25 nt, Homo sapiens
cugggugacggguuuggcccuaucc

SEQ ID NO: 6145 - RNA, 25 nt, Homo sapiens
ugggugacggguuuggcccuauccu

SEQ ID NO: 6146 - RNA, 25 nt, Homo sapiens
gucauucuccgagagcccguagaac

SEQ ID NO: 6147 - RNA, 25 nt, Homo sapiens
gagcccguagaacuggacuugacag

SEQ ID NO: 6148 - RNA, 25 nt, Homo sapiens
guagaacuggacuugacagcggaag

SEQ ID NO: 6149 - RNA, 25 nt, Homo sapiens
cuggacuugacagcggaagugguug

SEQ ID NO: 6150 - RNA, 25 nt, Homo sapiens
uggacuugacagcggaagugguugc

SEQ ID NO: 6151 - RNA, 25 nt, Homo sapiens
ggacuugacagcggaagugguugcg

SEQ ID NO: 6152 - RNA, 25 nt, Homo sapiens
gacuugacagcggaagugguugcgg

SEQ ID NO: 6153 - RNA, 25 nt, Homo sapiens
aagugguugcggggguucugccaga

SEQ ID NO: 6154 - RNA, 25 nt, Homo sapiens
ugguugcggggguucugccagaagg

SEQ ID NO: 6155 - RNA, 25 nt, Homo sapiens
cugccagaagguggccgagacccuc

SEQ ID NO: 6156 - RNA, 25 nt, Homo sapiens
ccagaagguggccgagacccucagg

SEQ ID NO: 6157 - RNA, 25 nt, Homo sapiens
ggccgagacccucaggcggcugcuc

SEQ ID NO: 6158 - RNA, 25 nt, Homo sapiens
cucaggcggcugcucaggcaguauc

SEQ ID NO: 6159 - RNA, 25 nt, Homo sapiens
gcucaggcaguaucuggagucauug

SEQ ID NO: 6160 - RNA, 25 nt, Homo sapiens
cucaggcaguaucuggagucauuga

SEQ ID NO: 6161 - RNA, 25 nt, Homo sapiens
aggcaguaucuggagucauugaggg

SEQ ID NO: 6162 - RNA, 25 nt, Homo sapiens
ggcaguaucuggagucauugagggc

SEQ ID NO: 6163 - RNA, 25 nt, Homo sapiens
gucauugagggcgggcugcuccuug

SEQ ID NO: 6164 - RNA, 25 nt, Homo sapiens
ucauugagggcgggcugcuccuuga

SEQ ID NO: 6165 - RNA, 25 nt, Homo sapiens
cauugagggcgggcugcuccuugag

SEQ ID NO: 6166 - RNA, 25 nt, Homo sapiens
gggcgggcugcuccuugaggggcug

SEQ ID NO: 6167 - RNA, 25 nt, Homo sapiens
ggcgggcugcuccuugaggggcugc

SEQ ID NO: 6168 - RNA, 25 nt, Homo sapiens
auucacccaccagcucagcuccacg

SEQ ID NO: 6169 - RNA, 25 nt, Homo sapiens
acccaccagcucagcuccacguggu

SEQ ID NO: 6170 - RNA, 25 nt, Homo sapiens
cccaccagcucagcuccacgugguc

SEQ ID NO: 6171 - RNA, 25 nt, Homo sapiens
ccaccagcucagcuccacguggucg

SEQ ID NO: 6172 - RNA, 25 nt, Homo sapiens
uccacguggucgggguagaagccug

SEQ ID NO: 6173 - RNA, 25 nt, Homo sapiens
guggucgggguagaagccuguggcc

SEQ ID NO: 6174 - RNA, 25 nt, Homo sapiens
aagccuguggccaggcauaccagug

SEQ ID NO: 6175 - RNA, 25 nt, Homo sapiens
ggccaggcauaccaguguggccuuu

SEQ ID NO: 6176 - RNA, 25 nt, Homo sapiens
gccaggcauaccaguguggccuuuu

SEQ ID NO: 6177 - RNA, 25 nt, Homo sapiens
gcauaccaguguggccuuuugggug

SEQ ID NO: 6178 - RNA, 25 nt, Homo sapiens
cauaccaguguggccuuuugggugu

SEQ ID NO: 6179 - RNA, 25 nt, Homo sapiens
gggugugggagaucucugcuucuga

SEQ ID NO: 6180 - RNA, 25 nt, Homo sapiens
ucugauggcucaaacacagcgaccu

SEQ ID NO: 6181 - RNA, 25 nt, Homo sapiens
cugauggcucaaacacagcgaccuc

SEQ ID NO: 6182 - RNA, 25 nt, Homo sapiens
auggcucaaacacagcgaccucggg

SEQ ID NO: 6183 - RNA, 25 nt, Homo sapiens
uggcucaaacacagcgaccucgggu

SEQ ID NO: 6184 - RNA, 25 nt, Homo sapiens
gaccucgggugggaacacguuuuuc

SEQ ID NO: 6185 - RNA, 25 nt, Homo sapiens
gugggaacacguuuuucagguccuc

SEQ ID NO: 6186 - RNA, 25 nt, Homo sapiens
aacacguuuuucagguccucuggaa

SEQ ID NO: 6187 - RNA, 25 nt, Homo sapiens
acacguuuuucagguccucuggaaa

SEQ ID NO: 6188 - RNA, 25 nt, Homo sapiens
uuuucagguccucuggaaagggaag

SEQ ID NO: 6189 - RNA, 25 nt, Homo sapiens
gguccucuggaaagggaagagguaa

SEQ ID NO: 6190 - RNA, 25 nt, Homo sapiens
guccucuggaaagggaagagguaau

SEQ ID NO: 6191 - RNA, 25 nt, Homo sapiens
uccucuggaaagggaagagguaaug

SEQ ID NO: 6192 - RNA, 25 nt, Homo sapiens
uucuuucagacuguggcuucaccuc

SEQ ID NO: 6193 - RNA, 25 nt, Homo sapiens
gugaagccacagucugaaagaaaac

SEQ ID NO: 6194 - RNA, 25 nt, Homo sapiens
ugaagccacagucugaaagaaaaca

SEQ ID NO: 6195 - RNA, 25 nt, Homo sapiens
gaagccacagucugaaagaaaacag

SEQ ID NO: 6196 - RNA, 25 nt, Homo sapiens
ucuugucaacagagucuuaccagca

SEQ ID NO: 6197 - RNA, 25 nt, Homo sapiens
cuugucaacagagucuuaccagcaa

SEQ ID NO: 6198 - RNA, 25 nt, Homo sapiens
uugucaacagagucuuaccagcaag

SEQ ID NO: 6199 - RNA, 25 nt, Homo sapiens
ccaccauccucuaugagaucuugcu

SEQ ID NO: 6200 - RNA, 25 nt, Homo sapiens
caccauccucuaugagaucuugcua

SEQ ID NO: 6201 - RNA, 25 nt, Homo sapiens
auccucuaugagaucuugcuaggga

SEQ ID NO: 6202 - RNA, 25 nt, Homo sapiens
gggaaggccaccuuguaugccgugc

SEQ ID NO: 6203 - RNA, 25 nt, Homo sapiens
gugcuggucagugcccucgugcuga

SEQ ID NO: 6204 - RNA, 25 nt, Homo sapiens
gucagugcccucgugcugauggcca

SEQ ID NO: 6205 - RNA, 25 nt, Homo sapiens
ugcccucgugcugauggccauggua

SEQ ID NO: 6206 - RNA, 25 nt, Homo sapiens
ccucgugcugauggccaugguaagg

SEQ ID NO: 6207 - RNA, 25 nt, Homo sapiens
cgugcugauggccaugguaaggagg

SEQ ID NO: 6208 - RNA, 25 nt, Homo sapiens
gugcugauggccaugguaaggagga

SEQ ID NO: 6209 - RNA, 25 nt, Homo sapiens
cugauggccaugguaaggaggaggg

SEQ ID NO: 6210 - RNA, 25 nt, Homo sapiens
ugauggccaugguaaggaggagggu

SEQ ID NO: 6211 - RNA, 25 nt, Homo sapiens
gccaugguaaggaggagggugggau

SEQ ID NO: 6212 - RNA, 25 nt, Homo sapiens
ccaugguaaggaggagggugggaua

SEQ ID NO: 6213 - RNA, 25 nt, Homo sapiens
cccuaucccacccuccuccuuacca

SEQ ID NO: 6214 - RNA, 25 nt, Homo sapiens
ccuccuuaccauggccaucagcacg

SEQ ID NO: 6215 - RNA, 25 nt, Homo sapiens
cuccuuaccauggccaucagcacga

SEQ ID NO: 6216 - RNA, 25 nt, Homo sapiens
aucagcacgagggcacugaccagca

SEQ ID NO: 6217 - RNA, 25 nt, Homo sapiens
agggcacugaccagcacggcauaca

SEQ ID NO: 6218 - RNA, 25 nt, Homo sapiens
gcacugaccagcacggcauacaagg

SEQ ID NO: 6219 - RNA, 25 nt, Homo sapiens
ggccuucccuagcaagaucucauag

SEQ ID NO: 6220 - RNA, 25 nt, Homo sapiens
uucccuagcaagaucucauagagga

SEQ ID NO: 6221 - RNA, 25 nt, Homo sapiens
ccuagcaagaucucauagaggaugg

SEQ ID NO: 6222 - RNA, 25 nt, Homo sapiens
gaucucauagaggaugguggcagac

SEQ ID NO: 6223 - RNA, 25 nt, Homo sapiens
gaugguggcagacaggaccccuugc

SEQ ID NO: 6224 - RNA, 25 nt, Homo sapiens
uucucucuuccacaggucaagagaa

SEQ ID NO: 6225 - RNA, 25 nt, Homo sapiens
cacaggucaagagaaaggauuccag

SEQ ID NO: 6226 - RNA, 25 nt, Homo sapiens
cucuggaauccuuucucuugaccug

SEQ ID NO: 6227 - RNA, 25 nt, Homo sapiens
uuccuccuacucaccaucagccucc

SEQ ID NO: 6228 - RNA, 25 nt, Homo sapiens
cuacucaccaucagccuccugguua

SEQ ID NO: 6229 - RNA, 25 nt, Homo sapiens
accaucagccuccugguuaugguac

SEQ ID NO: 6230 - RNA, 25 nt, Homo sapiens
uuaugguacagguaagagcaacgcc

SEQ ID NO: 6231 - RNA, 25 nt, Homo sapiens
cguugcucuuaccuguaccauaacc

SEQ ID NO: 6232 - RNA, 25 nt, Homo sapiens
ugcucuuaccuguaccauaaccagg

SEQ ID NO: 6233 - RNA, 25 nt, Homo sapiens
accuguaccauaaccaggaggcuga

SEQ ID NO: 6234 - RNA, 25 nt, Homo sapiens
cauaaccaggaggcugauggugagu

SEQ ID NO: 6235 - RNA, 25 nt, Homo sapiens
aaccaggaggcugauggugaguagg

SEQ ID NO: 6236 - RNA, 25 nt, Homo sapiens
gaggcugauggugaguaggaggaag

SEQ ID NO: 6237 - RNA, 25 nt, Homo sapiens
aggaggaagaggaagcgcuucauuu

SEQ ID NO: 6238 - RNA, 25 nt, Homo sapiens
ggaagaggaagcgcuucauuuuggu

SEQ ID NO: 6239 - RNA, 25 nt, Homo sapiens
gcgcuucauuuugguaggaucuucg

SEQ ID NO: 6240 - RNA, 25 nt, Homo sapiens
uuugguaggaucuucguggcugucu

SEQ ID NO: 6241 - RNA, 25 nt, Homo sapiens
guggcugucuugguagcagcuuuuu

SEQ ID NO: 6242 - RNA, 25 nt, Homo sapiens
ugguagcagcuuuuuaggugaucuc

SEQ ID NO: 6243 - RNA, 25 nt, Homo sapiens
gguagcagcuuuuuaggugaucuca

SEQ ID NO: 6244 - RNA, 25 nt, Homo sapiens
cuuuuuaggugaucucagggcuguc

SEQ ID NO: 6245 - RNA, 25 nt, Homo sapiens
uuuaggugaucucagggcugucugg

SEQ ID NO: 6246 - RNA, 25 nt, Homo sapiens
cucagggcugucuggaggcuucuuu

SEQ ID NO: 6247 - RNA, 25 nt, Homo sapiens
cuuuugguuuagcugcuuuugaacc

SEQ ID NO: 6248 - RNA, 25 nt, Homo sapiens
uugguuuagcugcuuuugaaccagg

SEQ ID NO: 6249 - RNA, 25 nt, Homo sapiens
uagcugcuuuugaaccaggaggcag

SEQ ID NO: 6250 - RNA, 25 nt, Homo sapiens
cugcuuuugaaccaggaggcagagg

SEQ ID NO: 6251 - RNA, 25 nt, Homo sapiens
cuuuugaaccaggaggcagaggagg

SEQ ID NO: 6252 - RNA, 25 nt, Homo sapiens
cacuucuccuccuacagauacaaac

SEQ ID NO: 6253 - RNA, 25 nt, Homo sapiens
uccuacagauacaaacuggacucuc

SEQ ID NO: 6254 - RNA, 25 nt, Homo sapiens
gccccucagcauccagcaacauaag

SEQ ID NO: 6255 - RNA, 25 nt, Homo sapiens
ccucagcauccagcaacauaagcgg

SEQ ID NO: 6256 - RNA, 25 nt, Homo sapiens
agcggaggcauuuuccuuuucuucg

SEQ ID NO: 6257 - RNA, 25 nt, Homo sapiens
uaauccaccucuucugcuucaguug

SEQ ID NO: 6258 - RNA, 25 nt, Homo sapiens
cucgcaagagaauccccuccaucuu

SEQ ID NO: 6259 - RNA, 25 nt, Homo sapiens
ucgcaagagaauccccuccaucuuu

SEQ ID NO: 6260 - RNA, 25 nt, Homo sapiens
caagagaauccccuccaucuuuggg

SEQ ID NO: 6261 - RNA, 25 nt, Homo sapiens
aagagaauccccuccaucuuuggga

SEQ ID NO: 6262 - RNA, 25 nt, Homo sapiens
agagaauccccuccaucuuugggag

SEQ ID NO: 6263 - RNA, 25 nt, Homo sapiens
ggagggguugaugccagacaucacc

SEQ ID NO: 6264 - RNA, 25 nt, Homo sapiens
acaucaccagguuguagaaguugac

SEQ ID NO: 6265 - RNA, 25 nt, Homo sapiens
uuguagaaguugacaggcagugcca

SEQ ID NO: 6266 - RNA, 25 nt, Homo sapiens
uguagaaguugacaggcagugccau

SEQ ID NO: 6267 - RNA, 25 nt, Homo sapiens
guagaaguugacaggcagugccaug

SEQ ID NO: 6268 - RNA, 25 nt, Homo sapiens
uagaaguugacaggcagugccaugg

SEQ ID NO: 6269 - RNA, 25 nt, Homo sapiens
gugccaugggggcaacagccaaaau

SEQ ID NO: 6270 - RNA, 25 nt, Homo sapiens
ugccaugggggcaacagccaaaaua

SEQ ID NO: 6271 - RNA, 25 nt, Homo sapiens
gccaugggggcaacagccaaaauag

SEQ ID NO: 6272 - RNA, 25 nt, Homo sapiens
ccaugggggcaacagccaaaauagg

SEQ ID NO: 6273 - RNA, 25 nt, Homo sapiens
caugggggcaacagccaaaauaggg

SEQ ID NO: 6274 - RNA, 25 nt, Homo sapiens
agccaaaauagggggguaaugaugu

SEQ ID NO: 6275 - RNA, 25 nt, Homo sapiens
gccaaaauagggggguaaugaugua

SEQ ID NO: 6276 - RNA, 25 nt, Homo sapiens
ccaaaauagggggguaaugauguag

SEQ ID NO: 6277 - RNA, 25 nt, Homo sapiens
auguaggggccaagcagugcccagc

SEQ ID NO: 6278 - RNA, 25 nt, Homo sapiens
uguaggggccaagcagugcccagcu

SEQ ID NO: 6279 - RNA, 25 nt, Homo sapiens
guaggggccaagcagugcccagcug

SEQ ID NO: 6280 - RNA, 25 nt, Homo sapiens
uaggggccaagcagugcccagcugg

SEQ ID NO: 6281 - RNA, 25 nt, Homo sapiens
aauaaaguuacccuuguacuugcag

SEQ ID NO: 6282 - RNA, 25 nt, Homo sapiens
auaaaguuacccuuguacuugcagu

SEQ ID NO: 6283 - RNA, 25 nt, Homo sapiens
uaaaguuacccuuguacuugcagug

SEQ ID NO: 6284 - RNA, 25 nt, Homo sapiens
uguacuugcagugggguccugcuug

SEQ ID NO: 6285 - RNA, 25 nt, Homo sapiens
gcagugggguccugcuugugguuac

SEQ ID NO: 6286 - RNA, 25 nt, Homo sapiens
guagggauguccaguaaccacaagc

SEQ ID NO: 6287 - RNA, 25 nt, Homo sapiens
caagcaggaccccacugcaaguaca

SEQ ID NO: 6288 - RNA, 25 nt, Homo sapiens
aagcaggaccccacugcaaguacaa

SEQ ID NO: 6289 - RNA, 25 nt, Homo sapiens
aaggguaacuuuauugacccccagc

SEQ ID NO: 6290 - RNA, 25 nt, Homo sapiens
aggguaacuuuauugacccccagcu

SEQ ID NO: 6291 - RNA, 25 nt, Homo sapiens
uauugacccccagcugggcacugcu

SEQ ID NO: 6292 - RNA, 25 nt, Homo sapiens
ccccuacaucauuaccccccuauuu

SEQ ID NO: 6293 - RNA, 25 nt, Homo sapiens
cccccuauuuuggcuguugccccca

SEQ ID NO: 6294 - RNA, 25 nt, Homo sapiens
gcacugccugucaacuucuacaacc

SEQ ID NO: 6295 - RNA, 25 nt, Homo sapiens
ucaacuucuacaaccuggugauguc

SEQ ID NO: 6296 - RNA, 25 nt, Homo sapiens
gucuggcaucaaccccucccaaaga

SEQ ID NO: 6297 - RNA, 25 nt, Homo sapiens
uggcaucaaccccucccaaagaugg

SEQ ID NO: 6298 - RNA, 25 nt, Homo sapiens
ggcaucaaccccucccaaagaugga

SEQ ID NO: 6299 - RNA, 25 nt, Homo sapiens
gcaucaaccccucccaaagauggag

SEQ ID NO: 6300 - RNA, 25 nt, Homo sapiens
auggaggggauucucuugcgaguga

SEQ ID NO: 6301 - RNA, 25 nt, Homo sapiens
gaggggauucucuugcgagugaugg

SEQ ID NO: 6302 - RNA, 25 nt, Homo sapiens
ugcgagugaugguggcagcuguuuc

SEQ ID NO: 6303 - RNA, 25 nt, Homo sapiens
gcgagugaugguggcagcuguuuca

SEQ ID NO: 6304 - RNA, 25 nt, Homo sapiens
cgagugaugguggcagcuguuucag

SEQ ID NO: 6305 - RNA, 25 nt, Homo sapiens
gagugaugguggcagcuguuucagg

SEQ ID NO: 6306 - RNA, 25 nt, Homo sapiens
ugguggcagcuguuucagggggcac

SEQ ID NO: 6307 - RNA, 25 nt, Homo sapiens
gguggcagcuguuucagggggcaca

SEQ ID NO: 6308 - RNA, 25 nt, Homo sapiens
agcuguuucagggggcacagggcua

SEQ ID NO: 6309 - RNA, 25 nt, Homo sapiens
cgugucaccucaacugaagcagaag

SEQ ID NO: 6310 - RNA, 25 nt, Homo sapiens
gucaccucaacugaagcagaagagg

SEQ ID NO: 6311 - RNA, 25 nt, Homo sapiens
caacugaagcagaagagguggauua

SEQ ID NO: 6312 - RNA, 25 nt, Homo sapiens
aagcagaagagguggauuauggcau

SEQ ID NO: 6313 - RNA, 25 nt, Homo sapiens
gauuauggcauuggccacgaagaaa

SEQ ID NO: 6314 - RNA, 25 nt, Homo sapiens
aggaaaaugccuccgcuuauguugc

SEQ ID NO: 6315 - RNA, 25 nt, Homo sapiens
ccuccgcuuauguugcuggaugcug

SEQ ID NO: 6316 - RNA, 25 nt, Homo sapiens
cuccgcuuauguugcuggaugcuga

SEQ ID NO: 6317 - RNA, 25 nt, Homo sapiens
uccgcuuauguugcuggaugcugag

SEQ ID NO: 6318 - RNA, 25 nt, Homo sapiens
auguugcuggaugcugaggggcugc

SEQ ID NO: 6319 - RNA, 25 nt, Homo sapiens
gcuggaugcugaggggcugcugguu

SEQ ID NO: 6320 - RNA, 25 nt, Homo sapiens
gaugcugaggggcugcugguuuggc

SEQ ID NO: 6321 - RNA, 25 nt, Homo sapiens
uccugagaguccaguuuguaucugu

SEQ ID NO: 6322 - RNA, 25 nt, Homo sapiens
ugagaguccaguuuguaucuguagg

SEQ ID NO: 6323 - RNA, 25 nt, Homo sapiens
caguuuguaucuguaggaggagaag

SEQ ID NO: 6324 - RNA, 25 nt, Homo sapiens
aguuuguaucuguaggaggagaagu

SEQ ID NO: 6325 - RNA, 25 nt, Homo sapiens
cgcgcgccguguggggcgcgcacgc

SEQ ID NO: 6326 - RNA, 25 nt, Homo sapiens
gcgcgccguguggggcgcgcacgca

SEQ ID NO: 6327 - RNA, 25 nt, Homo sapiens
gccguguggggcgcgcacgcagggc

SEQ ID NO: 6328 - RNA, 25 nt, Homo sapiens
ccguguggggcgcgcacgcagggcu

SEQ ID NO: 6329 - RNA, 25 nt, Homo sapiens
gggcgcgcacgcagggcugggcgug

SEQ ID NO: 6330 - RNA, 25 nt, Homo sapiens
ggcgcgcacgcagggcugggcguga

SEQ ID NO: 6331 - RNA, 25 nt, Homo sapiens
gcgcgcacgcagggcugggcgugag

SEQ ID NO: 6332 - RNA, 25 nt, Homo sapiens
cgcgcacgcagggcugggcgugagg

SEQ ID NO: 6333 - RNA, 25 nt, Homo sapiens
ggcgugagggggcgugcgcgugcgc

SEQ ID NO: 6334 - RNA, 25 nt, Homo sapiens
gugcgcgugcgcaggcgacgcgccg

SEQ ID NO: 6335 - RNA, 25 nt, Homo sapiens
ugcgcaggcgacgcgccgagguacu

SEQ ID NO: 6336 - RNA, 25 nt, Homo sapiens
cgcgccgagguacuaggcagagccg

SEQ ID NO: 6337 - RNA, 25 nt, Homo sapiens
uaggcagagccguggaaccgccgcc

SEQ ID NO: 6338 - RNA, 25 nt, Homo sapiens
cguggaaccgccgccaggucgcugu

SEQ ID NO: 6339 - RNA, 25 nt, Homo sapiens
gcccgcucagcguccgccgccgcca

SEQ ID NO: 6340 - RNA, 25 nt, Homo sapiens
cccgcucagcguccgccgccgccau

SEQ ID NO: 6341 - RNA, 25 nt, Homo sapiens
gcguccgccgccgccaugggagugc

SEQ ID NO: 6342 - RNA, 25 nt, Homo sapiens
uccgccgccgccaugggagugcagg

SEQ ID NO: 6343 - RNA, 25 nt, Homo sapiens
gagugcagguggaaaccaucucccc

SEQ ID NO: 6344 - RNA, 25 nt, Homo sapiens
agguggaaaccaucuccccaggaga

SEQ ID NO: 6345 - RNA, 25 nt, Homo sapiens
caucuccccaggagacggugaguag

SEQ ID NO: 6346 - RNA, 25 nt, Homo sapiens
ccaggagacggugaguaguggcgcg

SEQ ID NO: 6347 - RNA, 25 nt, Homo sapiens
ggagacggugaguaguggcgcgcgg

SEQ ID NO: 6348 - RNA, 25 nt, Homo sapiens
ccgcgcgccacuacucaccgucucc

SEQ ID NO: 6349 - RNA, 25 nt, Homo sapiens
cgcgcgccacuacucaccgucuccu

SEQ ID NO: 6350 - RNA, 25 nt, Homo sapiens
gcgcgccacuacucaccgucuccug

SEQ ID NO: 6351 - RNA, 25 nt, Homo sapiens
cacuacucaccgucuccuggggaga

SEQ ID NO: 6352 - RNA, 25 nt, Homo sapiens
gagaugguuuccaccugcacuccca

SEQ ID NO: 6353 - RNA, 25 nt, Homo sapiens
augguuuccaccugcacucccaugg

SEQ ID NO: 6354 - RNA, 25 nt, Homo sapiens
guuuccaccugcacucccauggcgg

SEQ ID NO: 6355 - RNA, 25 nt, Homo sapiens
uccaccugcacucccauggcggcgg

SEQ ID NO: 6356 - RNA, 25 nt, Homo sapiens
ucccauggcggcggcggacgcugag

SEQ ID NO: 6357 - RNA, 25 nt, Homo sapiens
cccauggcggcggcggacgcugagc

SEQ ID NO: 6358 - RNA, 25 nt, Homo sapiens
auggcggcggcggacgcugagcggg

SEQ ID NO: 6359 - RNA, 25 nt, Homo sapiens
uggcggcggcggacgcugagcgggc

SEQ ID NO: 6360 - RNA, 25 nt, Homo sapiens
cggcggcggacgcugagcgggcggg

SEQ ID NO: 6361 - RNA, 25 nt, Homo sapiens
gacgcugagcgggcgggcggcgcga

SEQ ID NO: 6362 - RNA, 25 nt, Homo sapiens
acgcugagcgggcgggcggcgcgac

SEQ ID NO: 6363 - RNA, 25 nt, Homo sapiens
cugagcgggcgggcggcgcgacggg

SEQ ID NO: 6364 - RNA, 25 nt, Homo sapiens
cgggcgggcggcgcgacgggcggcg

SEQ ID NO: 6365 - RNA, 25 nt, Homo sapiens
cgggcggcguggaccaacagcgacc

SEQ ID NO: 6366 - RNA, 25 nt, Homo sapiens
gcggcguggaccaacagcgaccugg

SEQ ID NO: 6367 - RNA, 25 nt, Homo sapiens
gcguggaccaacagcgaccuggcgg

SEQ ID NO: 6368 - RNA, 25 nt, Homo sapiens
caacagcgaccuggcggcgguucca

SEQ ID NO: 6369 - RNA, 25 nt, Homo sapiens
gguuccacggcucugccuaguaccu

SEQ ID NO: 6370 - RNA, 25 nt, Homo sapiens
cccagcccugcgugcgcgccccaca

SEQ ID NO: 6371 - RNA, 25 nt, Homo sapiens
ccucagggcgcaccuuccccaagcg

SEQ ID NO: 6372 - RNA, 25 nt, Homo sapiens
uuccccaagcgcggccagaccugcg

SEQ ID NO: 6373 - RNA, 25 nt, Homo sapiens
gccagaccugcguggugcacuacac

SEQ ID NO: 6374 - RNA, 25 nt, Homo sapiens
ugcguggugcacuacaccggugagu

SEQ ID NO: 6375 - RNA, 25 nt, Homo sapiens
gcguggugcacuacaccggugaguc

SEQ ID NO: 6376 - RNA, 25 nt, Homo sapiens
cguggugcacuacaccggugagucg

SEQ ID NO: 6377 - RNA, 25 nt, Homo sapiens
guggugcacuacaccggugagucgg

SEQ ID NO: 6378 - RNA, 25 nt, Homo sapiens
cuacaccggugagucgggggcccag

SEQ ID NO: 6379 - RNA, 25 nt, Homo sapiens
uacaccggugagucgggggcccagc

SEQ ID NO: 6380 - RNA, 25 nt, Homo sapiens
acaccggugagucgggggcccagcg

SEQ ID NO: 6381 - RNA, 25 nt, Homo sapiens
ccggugagucgggggcccagcgggg

SEQ ID NO: 6382 - RNA, 25 nt, Homo sapiens
gacucaccgguguagugcaccacgc

SEQ ID NO: 6383 - RNA, 25 nt, Homo sapiens
accgguguagugcaccacgcagguc

SEQ ID NO: 6384 - RNA, 25 nt, Homo sapiens
ugcaccacgcaggucuggccgcgcu

SEQ ID NO: 6385 - RNA, 25 nt, Homo sapiens
gcaccacgcaggucuggccgcgcuu

SEQ ID NO: 6386 - RNA, 25 nt, Homo sapiens
caccacgcaggucuggccgcgcuug

SEQ ID NO: 6387 - RNA, 25 nt, Homo sapiens
acgcaggucuggccgcgcuugggga

SEQ ID NO: 6388 - RNA, 25 nt, Homo sapiens
ccgcgcuuggggaaggugcgcccug

SEQ ID NO: 6389 - RNA, 25 nt, Homo sapiens
aaggugcgcccugaggagacagaga

SEQ ID NO: 6390 - RNA, 25 nt, Homo sapiens
aggugcgcccugaggagacagagac

SEQ ID NO: 6391 - RNA, 25 nt, Homo sapiens
ucuuuuucacagggaugcuugaaga

SEQ ID NO: 6392 - RNA, 25 nt, Homo sapiens
agauggaaagaaauuugauuccucc

SEQ ID NO: 6393 - RNA, 25 nt, Homo sapiens
gauggaaagaaauuugauuccuccc

SEQ ID NO: 6394 - RNA, 25 nt, Homo sapiens
gaaacaagcccuuuaaguuuaugcu

SEQ ID NO: 6395 - RNA, 25 nt, Homo sapiens
cccuuuaaguuuaugcuaggcaagc

SEQ ID NO: 6396 - RNA, 25 nt, Homo sapiens
uuuaaguuuaugcuaggcaagcagg

SEQ ID NO: 6397 - RNA, 25 nt, Homo sapiens
ugcuaggcaagcaggaggugauccg

SEQ ID NO: 6398 - RNA, 25 nt, Homo sapiens
aggcaagcaggaggugauccgaggc

SEQ ID NO: 6399 - RNA, 25 nt, Homo sapiens
ggcaagcaggaggugauccgaggcu

SEQ ID NO: 6400 - RNA, 25 nt, Homo sapiens
aggaggugauccgaggcugggaaga

SEQ ID NO: 6401 - RNA, 25 nt, Homo sapiens
ggaggugauccgaggcugggaagaa

SEQ ID NO: 6402 - RNA, 25 nt, Homo sapiens
gaggugauccgaggcugggaagaag

SEQ ID NO: 6403 - RNA, 25 nt, Homo sapiens
cgaggcugggaagaagggguugccc

SEQ ID NO: 6404 - RNA, 25 nt, Homo sapiens
aacaaaacaaaugagagagcauacc

SEQ ID NO: 6405 - RNA, 25 nt, Homo sapiens
acaaaacaaaugagagagcauaccu

SEQ ID NO: 6406 - RNA, 25 nt, Homo sapiens
cugggcaaccccuucuucccagccu

SEQ ID NO: 6407 - RNA, 25 nt, Homo sapiens
uccugcuugccuagcauaaacuuaa

SEQ ID NO: 6408 - RNA, 25 nt, Homo sapiens
ccugcuugccuagcauaaacuuaaa

SEQ ID NO: 6409 - RNA, 25 nt, Homo sapiens
aaacuuaaagggcuuguuucugucc

SEQ ID NO: 6410 - RNA, 25 nt, Homo sapiens
aacuuaaagggcuuguuucuguccc

SEQ ID NO: 6411 - RNA, 25 nt, Homo sapiens
uuaaagggcuuguuucugucccggg

SEQ ID NO: 6412 - RNA, 25 nt, Homo sapiens
uccuuguucuuuucacagaugagug

SEQ ID NO: 6413 - RNA, 25 nt, Homo sapiens
ccuuguucuuuucacagaugagugu

SEQ ID NO: 6414 - RNA, 25 nt, Homo sapiens
ugacuauaucuccagauuaugccua

SEQ ID NO: 6415 - RNA, 25 nt, Homo sapiens
cuccagauuaugccuauggugccac

SEQ ID NO: 6416 - RNA, 25 nt, Homo sapiens
uccagauuaugccuauggugccacu

SEQ ID NO: 6417 - RNA, 25 nt, Homo sapiens
augccuauggugccacugggcaccc

SEQ ID NO: 6418 - RNA, 25 nt, Homo sapiens
ccacaugccacucucgucuucgaug

SEQ ID NO: 6419 - RNA, 25 nt, Homo sapiens
gucuucgauguggagcuucuaaaac

SEQ ID NO: 6420 - RNA, 25 nt, Homo sapiens
guggagcuucuaaaacuggaaugac

SEQ ID NO: 6421 - RNA, 25 nt, Homo sapiens
gcuucuaaaacuggaaugacaggaa

SEQ ID NO: 6422 - RNA, 25 nt, Homo sapiens
gccuccucccuuagcucccuguucu

SEQ ID NO: 6423 - RNA, 25 nt, Homo sapiens
ccuccucccuuagcucccuguucuu

SEQ ID NO: 6424 - RNA, 25 nt, Homo sapiens
ucccuuagcucccuguucuugggua

SEQ ID NO: 6425 - RNA, 25 nt, Homo sapiens
agcucccuguucuuggguaaggaaa

SEQ ID NO: 6426 - RNA, 25 nt, Homo sapiens
cuuggguaaggaaauggaauacuga

SEQ ID NO: 6427 - RNA, 25 nt, Homo sapiens
uuggguaaggaaauggaauacugaa

SEQ ID NO: 6428 - RNA, 25 nt, Homo sapiens
guauuccauuuccuuacccaagaac

SEQ ID NO: 6429 - RNA, 25 nt, Homo sapiens
uauuccauuuccuuacccaagaaca

SEQ ID NO: 6430 - RNA, 25 nt, Homo sapiens
uuccuuacccaagaacagggagcua

SEQ ID NO: 6431 - RNA, 25 nt, Homo sapiens
uccuuacccaagaacagggagcuaa

SEQ ID NO: 6432 - RNA, 25 nt, Homo sapiens
uuacccaagaacagggagcuaaggg

SEQ ID NO: 6433 - RNA, 25 nt, Homo sapiens
cccaagaacagggagcuaagggagg

SEQ ID NO: 6434 - RNA, 25 nt, Homo sapiens
agaagcuccacaucgaagacgagag

SEQ ID NO: 6435 - RNA, 25 nt, Homo sapiens
ccacaucgaagacgagaguggcaug

SEQ ID NO: 6436 - RNA, 25 nt, Homo sapiens
caucgaagacgagaguggcaugugg

SEQ ID NO: 6437 - RNA, 25 nt, Homo sapiens
aucgaagacgagaguggcauguggu

SEQ ID NO: 6438 - RNA, 25 nt, Homo sapiens
gaguggcauguggugggaugaugcc

SEQ ID NO: 6439 - RNA, 25 nt, Homo sapiens
aguggcauguggugggaugaugccu

SEQ ID NO: 6440 - RNA, 25 nt, Homo sapiens
ggugggaugaugccugggugcccag

SEQ ID NO: 6441 - RNA, 25 nt, Homo sapiens
augccugggugcccaguggcaccau

SEQ ID NO: 6442 - RNA, 25 nt, Homo sapiens
gcccaguggcaccauaggcauaauc

SEQ ID NO: 6443 - RNA, 25 nt, Homo sapiens
gcauaaucuggagauauagucaguu

SEQ ID NO: 6444 - RNA, 25 nt, Homo sapiens
cccacacucaucugugaaaagaaca

SEQ ID NO: 6445 - RNA, 25 nt, Homo sapiens
uuuucuguccccaacagaucugcca

SEQ ID NO: 6446 - RNA, 25 nt, Homo sapiens
ucuguccccaacagaucugccaugg

SEQ ID NO: 6447 - RNA, 25 nt, Homo sapiens
cuguccccaacagaucugccaugga

SEQ ID NO: 6448 - RNA, 25 nt, Homo sapiens
ccaacagaucugccauggagggauc

SEQ ID NO: 6449 - RNA, 25 nt, Homo sapiens
ccagacaugugcacaugaauccaua

SEQ ID NO: 6450 - RNA, 25 nt, Homo sapiens
uauucauuuuauuuuguuuucauuu

SEQ ID NO: 6451 - RNA, 25 nt, Homo sapiens
auucauuuuauuuuguuuucauuuu

SEQ ID NO: 6452 - RNA, 25 nt, Homo sapiens
uucauuuuauuuuguuuucauuuug

SEQ ID NO: 6453 - RNA, 25 nt, Homo sapiens
gggugaagauucaguuucagucuuu

SEQ ID NO: 6454 - RNA, 25 nt, Homo sapiens
gauucaguuucagucuuuuggauau

SEQ ID NO: 6455 - RNA, 25 nt, Homo sapiens
ggauauagguuuccaauuaaguaca

SEQ ID NO: 6456 - RNA, 25 nt, Homo sapiens
cauggucaaguauuaacagcacaag

SEQ ID NO: 6457 - RNA, 25 nt, Homo sapiens
gucaaguauuaacagcacaaguggu

SEQ ID NO: 6458 - RNA, 25 nt, Homo sapiens
acaagugguagguuaacauuagaau

SEQ ID NO: 6459 - RNA, 25 nt, Homo sapiens
gguagguuaacauuagaauaggaau

SEQ ID NO: 6460 - RNA, 25 nt, Homo sapiens
uuaacauuagaauaggaauuggugu

SEQ ID NO: 6461 - RNA, 25 nt, Homo sapiens
uaacauuagaauaggaauugguguu

SEQ ID NO: 6462 - RNA, 25 nt, Homo sapiens
aacauuagaauaggaauugguguug

SEQ ID NO: 6463 - RNA, 25 nt, Homo sapiens
acauuagaauaggaauugguguugg

SEQ ID NO: 6464 - RNA, 25 nt, Homo sapiens
cauuagaauaggaauugguguuggg

SEQ ID NO: 6465 - RNA, 25 nt, Homo sapiens
auuagaauaggaauugguguugggg

SEQ ID NO: 6466 - RNA, 25 nt, Homo sapiens
uuagaauaggaauugguguuggggg

SEQ ID NO: 6467 - RNA, 25 nt, Homo sapiens
uagaauaggaauugguguugggggg

SEQ ID NO: 6468 - RNA, 25 nt, Homo sapiens
agaauaggaauugguguuggggggg

SEQ ID NO: 6469 - RNA, 25 nt, Homo sapiens
gcaagaauauuuuauuuuaauuuuu

SEQ ID NO: 6470 - RNA, 25 nt, Homo sapiens
gcgcugcaaagccauagcagauuug

SEQ ID NO: 6471 - RNA, 25 nt, Homo sapiens
ccauagcagauuugaggcgcuguug

SEQ ID NO: 6472 - RNA, 25 nt, Homo sapiens
uacucuccaaguugagagaugucuu

SEQ ID NO: 6473 - RNA, 25 nt, Homo sapiens
acucuccaaguugagagaugucuuu

SEQ ID NO: 6474 - RNA, 25 nt, Homo sapiens
aaauuaaaagcccuaccuaaaacug

SEQ ID NO: 6475 - RNA, 25 nt, Homo sapiens
uuaaaagcccuaccuaaaacugagg

SEQ ID NO: 6476 - RNA, 25 nt, Homo sapiens
uaaaagcccuaccuaaaacugaggu

SEQ ID NO: 6477 - RNA, 25 nt, Homo sapiens
aaaagcccuaccuaaaacugaggug

SEQ ID NO: 6478 - RNA, 25 nt, Homo sapiens
gcccuaccuaaaacugaggugggga

SEQ ID NO: 6479 - RNA, 25 nt, Homo sapiens
cccuaccuaaaacugagguggggau

SEQ ID NO: 6480 - RNA, 25 nt, Homo sapiens
ccuaccuaaaacugagguggggaug

SEQ ID NO: 6481 - RNA, 25 nt, Homo sapiens
aaguagaucauguucacugcaaugc

SEQ ID NO: 6482 - RNA, 25 nt, Homo sapiens
uguucacugcaaugcuggacacuac

SEQ ID NO: 6483 - RNA, 25 nt, Homo sapiens
gcuggacacuacagguaucuguccc

SEQ ID NO: 6484 - RNA, 25 nt, Homo sapiens
cuggacacuacagguaucugucccu

SEQ ID NO: 6485 - RNA, 25 nt, Homo sapiens
uacagguaucugucccugggccagc

SEQ ID NO: 6486 - RNA, 25 nt, Homo sapiens
acagguaucugucccugggccagca

SEQ ID NO: 6487 - RNA, 25 nt, Homo sapiens
gcagggaccucugaagccuucuuug

SEQ ID NO: 6488 - RNA, 25 nt, Homo sapiens
guggccuuuuuuuuuuuucauccug

SEQ ID NO: 6489 - RNA, 25 nt, Homo sapiens
uuuuuucauccugugguuuuucuaa

SEQ ID NO: 6490 - RNA, 25 nt, Homo sapiens
ccugugguuuuucuaauggacuuuc

SEQ ID NO: 6491 - RNA, 25 nt, Homo sapiens
aacuuuaauugacaguuucaauuga

SEQ ID NO: 6492 - RNA, 25 nt, Homo sapiens
gaauguucucuuaagaaaaugaugc

SEQ ID NO: 6493 - RNA, 25 nt, Homo sapiens
ucagcaucuccuguuuuuugaugcu

SEQ ID NO: 6494 - RNA, 25 nt, Homo sapiens
gcucccucugcugaucucaguuucc

SEQ ID NO: 6495 - RNA, 25 nt, Homo sapiens
cccuuugcuguccuguguagugauu

SEQ ID NO: 6496 - RNA, 25 nt, Homo sapiens
uuauugcaauaaaagugcuuuaugc

SEQ ID NO: 6497 - RNA, 25 nt, Homo sapiens
gccggcuuuucucagcucuguguca

SEQ ID NO: 6498 - RNA, 25 nt, Homo sapiens
ggcuuuucucagcucugugucaugg

SEQ ID NO: 6499 - RNA, 25 nt, Homo sapiens
gcucugugucauggugguuauuuuc

SEQ ID NO: 6500 - RNA, 25 nt, Homo sapiens
auuuucaggugccuccccugccauu

SEQ ID NO: 6501 - RNA, 25 nt, Homo sapiens
accaugacacagagcugagaaaagc

SEQ ID NO: 6502 - RNA, 25 nt, Homo sapiens
aauaauaaaacuugagacucauaaa

SEQ ID NO: 6503 - RNA, 25 nt, Homo sapiens
aaaacuugagacucauaaauggugc

SEQ ID NO: 6504 - RNA, 25 nt, Homo sapiens
aaacuugagacucauaaauggugcu

SEQ ID NO: 6505 - RNA, 25 nt, Homo sapiens
aacuugagacucauaaauggugcug

SEQ ID NO: 6506 - RNA, 25 nt, Homo sapiens
acuugagacucauaaauggugcugg

SEQ ID NO: 6507 - RNA, 25 nt, Homo sapiens
gagacucauaaauggugcuggggga

SEQ ID NO: 6508 - RNA, 25 nt, Homo sapiens
agacucauaaauggugcugggggaa

SEQ ID NO: 6509 - RNA, 25 nt, Homo sapiens
acgauuucucaccaaaucacuacac

SEQ ID NO: 6510 - RNA, 25 nt, Homo sapiens
accaaaucacuacacaggacagcaa

SEQ ID NO: 6511 - RNA, 25 nt, Homo sapiens
ccaaaucacuacacaggacagcaaa

SEQ ID NO: 6512 - RNA, 25 nt, Homo sapiens
caaaucacuacacaggacagcaaag

SEQ ID NO: 6513 - RNA, 25 nt, Homo sapiens
uacacaggacagcaaaggggugaga

SEQ ID NO: 6514 - RNA, 25 nt, Homo sapiens
acacaggacagcaaaggggugagaa

SEQ ID NO: 6515 - RNA, 25 nt, Homo sapiens
cacaggacagcaaaggggugagaag

SEQ ID NO: 6516 - RNA, 25 nt, Homo sapiens
acagcaaaggggugagaaggggcug

SEQ ID NO: 6517 - RNA, 25 nt, Homo sapiens
cagcaaaggggugagaaggggcuga

SEQ ID NO: 6518 - RNA, 25 nt, Homo sapiens
caaaggggugagaaggggcugaggg

SEQ ID NO: 6519 - RNA, 25 nt, Homo sapiens
agaaggggcugagggaggaaaagcc

SEQ ID NO: 6520 - RNA, 25 nt, Homo sapiens
aaagccaggaaacugagaucagcag

SEQ ID NO: 6521 - RNA, 25 nt, Homo sapiens
aagccaggaaacugagaucagcaga

SEQ ID NO: 6522 - RNA, 25 nt, Homo sapiens
cagagggagccaagcaucaaaaaac

SEQ ID NO: 6523 - RNA, 25 nt, Homo sapiens
caucauuuucuuaagagaacauuca

SEQ ID NO: 6524 - RNA, 25 nt, Homo sapiens
gagaacauucaaggauuugucauga

SEQ ID NO: 6525 - RNA, 25 nt, Homo sapiens
acauucaaggauuugucaugauggc

SEQ ID NO: 6526 - RNA, 25 nt, Homo sapiens
cauucaaggauuugucaugauggcu

SEQ ID NO: 6527 - RNA, 25 nt, Homo sapiens
uuugucaugauggcugggcuuucac

SEQ ID NO: 6528 - RNA, 25 nt, Homo sapiens
uugucaugauggcugggcuuucacu

SEQ ID NO: 6529 - RNA, 25 nt, Homo sapiens
cugucaauuaaaguucuuaagauuu

SEQ ID NO: 6530 - RNA, 25 nt, Homo sapiens
auuaaaguucuuaagauuuaggaag

SEQ ID NO: 6531 - RNA, 25 nt, Homo sapiens
aaaguucuuaagauuuaggaagugg

SEQ ID NO: 6532 - RNA, 25 nt, Homo sapiens
uuaagauuuaggaagugguggagcu

SEQ ID NO: 6533 - RNA, 25 nt, Homo sapiens
ccugaaaguccauuagaaaaaccac

SEQ ID NO: 6534 - RNA, 25 nt, Homo sapiens
aaaaccacaggaugaaaaaaaaaaa

SEQ ID NO: 6535 - RNA, 25 nt, Homo sapiens
ugaaaaaaaaaaaaggccacaaaga

SEQ ID NO: 6536 - RNA, 25 nt, Homo sapiens
aaaaaggccacaaagaaggcuucag

SEQ ID NO: 6537 - RNA, 25 nt, Homo sapiens
caaagaaggcuucagaggucccugc

SEQ ID NO: 6538 - RNA, 25 nt, Homo sapiens
aggcuucagaggucccugcuggccc

SEQ ID NO: 6539 - RNA, 25 nt, Homo sapiens
ggcuucagaggucccugcuggccca

SEQ ID NO: 6540 - RNA, 25 nt, Homo sapiens
ugcagugaacaugaucuacuuucaa

SEQ ID NO: 6541 - RNA, 25 nt, Homo sapiens
gaacaugaucuacuuucaaaggcag

SEQ ID NO: 6542 - RNA, 25 nt, Homo sapiens
aacaugaucuacuuucaaaggcaga

SEQ ID NO: 6543 - RNA, 25 nt, Homo sapiens
ucuacuuucaaaggcagaggguuua

SEQ ID NO: 6544 - RNA, 25 nt, Homo sapiens
cuacuuucaaaggcagaggguuuaa

SEQ ID NO: 6545 - RNA, 25 nt, Homo sapiens
uacuuucaaaggcagaggguuuaag

SEQ ID NO: 6546 - RNA, 25 nt, Homo sapiens
uuucaaaggcagaggguuuaagggg

SEQ ID NO: 6547 - RNA, 25 nt, Homo sapiens
uucaaaggcagaggguuuaagggga

SEQ ID NO: 6548 - RNA, 25 nt, Homo sapiens
aaaggcagaggguuuaaggggaggg

SEQ ID NO: 6549 - RNA, 25 nt, Homo sapiens
aaggcagaggguuuaaggggagggu

SEQ ID NO: 6550 - RNA, 25 nt, Homo sapiens
gcagaggguuuaaggggaggguggg

SEQ ID NO: 6551 - RNA, 25 nt, Homo sapiens
cagaggguuuaaggggagggugggu

SEQ ID NO: 6552 - RNA, 25 nt, Homo sapiens
gguuuaaggggagggugggugggaa

SEQ ID NO: 6553 - RNA, 25 nt, Homo sapiens
uuaaggggagggugggugggaaugg

SEQ ID NO: 6554 - RNA, 25 nt, Homo sapiens
aggggagggugggugggaauggugg

SEQ ID NO: 6555 - RNA, 25 nt, Homo sapiens
gggugggugggaaugguggaggcaa

SEQ ID NO: 6556 - RNA, 25 nt, Homo sapiens
cucuccccauccccaccucaguuuu

SEQ ID NO: 6557 - RNA, 25 nt, Homo sapiens
ccccauccccaccucaguuuuaggu

SEQ ID NO: 6558 - RNA, 25 nt, Homo sapiens
cccauccccaccucaguuuuaggua

SEQ ID NO: 6559 - RNA, 25 nt, Homo sapiens
uuuaacccaaagacaucucucaacu

SEQ ID NO: 6560 - RNA, 25 nt, Homo sapiens
ccucaacagcgccucaaaucugcua

SEQ ID NO: 6561 - RNA, 25 nt, Homo sapiens
guuaauacuugaccauguacuuaau

SEQ ID NO: 6562 - RNA, 25 nt, Homo sapiens
aaaacaaaauaaaaugaauaacuug

SEQ ID NO: 6563 - RNA, 25 nt, Homo sapiens
aauaaaaugaauaacuugagguuua

SEQ ID NO: 6564 - RNA, 25 nt, Homo sapiens
acuugagguuuauggcauauaguuu

SEQ ID NO: 6565 - RNA, 25 nt, Homo sapiens
uauaguuuagguaaacacacauacg

SEQ ID NO: 6566 - RNA, 25 nt, Homo sapiens
uagguaaacacacauacgaggagaa

SEQ ID NO: 6567 - RNA, 25 nt, Homo sapiens
agguaaacacacauacgaggagaaa

SEQ ID NO: 6568 - RNA, 25 nt, Homo sapiens
gguaaacacacauacgaggagaaag

SEQ ID NO: 6569 - RNA, 25 nt, Homo sapiens
cacacauacgaggagaaaggggaag

SEQ ID NO: 6570 - RNA, 25 nt, Homo sapiens
gaggagaaaggggaagaggaaacag

SEQ ID NO: 6571 - RNA, 25 nt, Homo sapiens
aaaggggaagaggaaacagaggugu

SEQ ID NO: 6572 - RNA, 25 nt, Homo sapiens
gcugagugacagaacacauucaguc

SEQ ID NO: 6573 - RNA, 25 nt, Homo sapiens
cugagugacagaacacauucaguca

SEQ ID NO: 6574 - RNA, 25 nt, Homo sapiens
agucagggcagaugucuauacaaag

SEQ ID NO: 6575 - RNA, 25 nt, Homo sapiens
gggcagaugucuauacaaaguggag

SEQ ID NO: 6576 - RNA, 25 nt, Homo sapiens
ucuauacaaaguggaguggaacauc

SEQ ID NO: 6577 - RNA, 25 nt, Homo sapiens
guggaacaucaggaaaagcuccaua

SEQ ID NO: 6578 - RNA, 25 nt, Homo sapiens
ccauauggauucaugugcacauguc

SEQ ID NO: 6579 - RNA, 25 nt, Homo sapiens
uauggauucaugugcacaugucugg

SEQ ID NO: 6580 - RNA, 25 nt, Homo sapiens
ugucuggaggcaccagaucccucca

SEQ ID NO: 6581 - RNA, 25 nt, Homo sapiens
ccagaucccuccauggcagaucugu

SEQ ID NO: 6582 - RNA, 25 nt, Homo sapiens
cagaucccuccauggcagaucuguu

SEQ ID NO: 6583 - RNA, 25 nt, Homo sapiens
agaucccuccauggcagaucuguug

SEQ ID NO: 6584 - RNA, 12 nt, Artificial Sequence
  source: /note="Description of Artificial Sequence: Synthetic oligonucleotide"
guuuuagagcua

SEQ ID NO: 6585 - RNA, 12 nt, Artificial Sequence
  source: /note="Description of Artificial Sequence: Synthetic oligonucleotide"
guuuaagagcua

SEQ ID NO: 6586 - RNA, 5 nt, Artificial Sequence
  source: /note="Description of Artificial Sequence: Synthetic oligonucleotide"
ugcug

SEQ ID NO: 6587 - RNA, 5 nt, Artificial Sequence
  source: /note="Description of Artificial Sequence: Synthetic oligonucleotide"
uuuug

SEQ ID NO: 6588 - RNA, 4 nt, Artificial Sequence
  source: /note="Description of Artificial Sequence: Synthetic oligonucleotide"
gaaa

SEQ ID NO: 6589 - RNA, 60 nt, Artificial Sequence
  source: /note="Description of Artificial Sequence: Synthetic oligonucleotide"
uagcaaguuaaaauaaggcuaguccguuaucaacuugaaaaaguggcaccgagucggugc

SEQ ID NO: 6590 - RNA, 60 nt, Artificial Sequence
  source: /note="Description of Artificial Sequence: Synthetic oligonucleotide"
uagcaaguuuaaauaaggcuaguccguuaucaacuugaaaaaguggcaccgagucggugc

SEQ ID NO: 6591 - RNA, 5 nt, Artificial Sequence
  source: /note="Description of Artificial Sequence: Synthetic oligonucleotide"
cagca

SEQ ID NO: 6592 - protein, 40 aa, Artificial Sequence
  source: /note="Description of Artificial Sequence: Synthetic polypeptide"
  MISC_FEATURE (1)..(40): /note="This sequence may encompass 1-10 'Gly-Gly-Gly-Ser' repeating units"
GGGSGGGSGGGSGGGSGGGSGGGSGGGSGGGSGGGSGGGS

SEQ ID NO: 6593 - protein, 20 aa, Artificial Sequence
  source: /note="Description of Artificial Sequence: Synthetic peptide"
GGGGSGGGGSGGGGSGGGGS

SEQ ID NO: 6594 - protein, 15 aa, Artificial Sequence
  source: /note="Description of Artificial Sequence: Synthetic peptide"
GGGGSGGGGSGGGGS

SEQ ID NO: 6595 - protein, 4 aa, Artificial Sequence
  source: /note="Description of Artificial Sequence: Synthetic peptide"
GGGS

SEQ ID NO: 6596 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 6597 - RNA, 13 nt, Artificial Sequence
  source: /note="Description of Artificial Sequence: Synthetic oligonucleotide"
uagcaaguuaaaa

SEQ ID NO: 6598 - RNA, 13 nt, Artificial Sequence
  source: /note="Description of Artificial Sequence: Synthetic oligonucleotide"
uagcaaguuuaaa

SEQ ID NO: 6599 - RNA, 47 nt, Artificial Sequence
  source: /note="Description of Artificial Sequence: Synthetic oligonucleotide"
uaaggcuaguccguuaucaacuugaaaaaguggcaccgagucggugc

SEQ ID NO: 6600 - RNA, 51 nt, Artificial Sequence
  source: /note="Description of Artificial Sequence: Synthetic oligonucleotide"
uaaggcuaguccguuaucaacuugaaaaaguggcaccgagucggugcuuuu

SEQ ID NO: 6601 - RNA, 76 nt, Artificial Sequence
  source: /note="Description of Artificial Sequence: Synthetic oligonucleotide"
guuuuagagcuagaaauagcaaguuaaaauaaggcuaguccguuaucaacuugaaaaaguggcaccgagucggugc

SEQ ID NO: 6602 - RNA, 76 nt, Artificial Sequence
  source: /note="Description of Artificial Sequence: Synthetic oligonucleotide"
guuuaagagcuagaaauagcaaguuuaaauaaggcuaguccguuaucaacuugaaaaaguggcaccgagucggugc

SEQ ID NO: 6603 - RNA, 86 nt, Artificial Sequence
  source: /note="Description of Artificial Sequence: Synthetic oligonucleotide"
guuuuagagcuaugcuggaaacagcauagcaaguuaaaauaaggcuaguccguuaucaacuugaaaaaguggcaccgagucggugc

SEQ ID NO: 6604 - RNA, 86 nt, Artificial Sequence
  source: /note="Description of Artificial Sequence: Synthetic oligonucleotide"
guuuaagagcuaugcuggaaacagcauagcaaguuuaaauaaggcuaguccguuaucaacuugaaaaaguggcaccgagucggugc

SEQ ID NO: 6605 - RNA, 17 nt, Artificial Sequence
  source: /note="Description of Artificial Sequence: Synthetic oligonucleotide"
guuuuagagcuaugcug

SEQ ID NO: 6606 - RNA, 17 nt, Artificial Sequence
  source: /note="Description of Artificial Sequence: Synthetic oligonucleotide"
guuuaagagcuaugcug

SEQ ID NO: 6607 - RNA, 22 nt, Artificial Sequence
  source: /note="Description of Artificial Sequence: Synthetic oligonucleotide"
guuuuagagcuaugcuguuuug

SEQ ID NO: 6608 - RNA, 22 nt, Artificial Sequence
  source: /note="Description of Artificial Sequence: Synthetic oligonucleotide"
guuuaagagcuaugcuguuuug

SEQ ID NO: 6609 - RNA, 65 nt, Artificial Sequence
  source: /note="Description of Artificial Sequence: Synthetic oligonucleotide"
cagcauagcaaguuaaaauaaggcuaguccguuaucaacuugaaaaaguggcaccgagucggugc

SEQ ID NO: 6610 - RNA, 65 nt, Artificial Sequence
  source: /note="Description of Artificial Sequence: Synthetic oligonucleotide"
cagcauagcaaguuuaaauaaggcuaguccguuaucaacuugaaaaaguggcaccgagucggugc

SEQ ID NO: 6611 - protein, 1368 aa, Streptococcus pyogenes [sequence omitted]

SEQ ID NO: 6612 - protein, 7 aa, Simian virus 40
PKKKRKV

SEQ ID NO: 6613 - protein, 16 aa, Unknown
  source: /note="Description of Unknown: Nucleoplasmin bipartite NLS sequence"
KRPAATKKAGQAKKKK

SEQ ID NO: 6614 - protein, 9 aa, Unknown
  source: /note="Description of Unknown: C-myc NLS sequence"
PAAKRVKLD

SEQ ID NO: 6615 - protein, 11 aa, Unknown
  source: /note="Description of Unknown: C-myc NLS sequence"
RQRRNELKRSP

SEQ ID NO: 6616 - protein, 38 aa, Homo sapiens
NQSSNFGPMKGGNFGGRSSGPYGGGGQYFAKPRNQGGY

SEQ ID NO: 6617 - protein, 42 aa, Unknown
  source: /note="Description of Unknown: IBB domain from importin-alpha sequence"
RMRIZFKNKGKDTAELRRRRVEVSVELRKAKKDEQILKRRNV

SEQ ID NO: 6618 - protein, 8 aa, Unknown
  source: /note="Description of Unknown: Myoma T protein sequence"
VSRKRPRP

SEQ ID NO: 6619 - protein, 8 aa, Unknown
  source: /note="Description of Unknown: Myoma T protein sequence"
PPKKARED

SEQ ID NO: 6620 - protein, 8 aa, Homo sapiens
PQPKKKPL

SEQ ID NO: 6621 - protein, 12 aa, Mus musculus
SALIKKKKKMAP

SEQ ID NO: 6622 - protein, 5 aa, Influenza virus
DRLRR

SEQ ID NO: 6623 - protein, 7 aa, Influenza virus
PKQKKRK

SEQ ID NO: 6624 - protein, 10 aa, Hepatitis delta virus
RKLKKKIKKL

SEQ ID NO: 6625 - protein, 10 aa, Mus musculus
REKKKFLKRR

SEQ ID NO: 6626 - protein, 20 aa, Homo sapiens
KRKGDEVDGVDEVAKKKSKK

SEQ ID NO: 6627 - protein, 17 aa, Homo sapiens
RKCLQAGMNLEARKTKK

SEQ ID NO: 6628 - DNA, 4107 bp, Artificial Sequence
  source: /note="Description of Artificial Sequence: Synthetic polynucleotide"
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 6629 - protein, 5 aa, Artificial Sequence
  source: /note="Description of Artificial Sequence: Synthetic peptide"
GGGGS

SEQ ID NO: 6630 - protein, 230 aa, Artificial Sequence
  source: /note="Description of Artificial Sequence: Synthetic polypeptide"
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 6631 - DNA, 690 bp, Artificial Sequence
  source: /note="Description of Artificial Sequence: Synthetic polynucleotide"
gagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatg

SEQ ID NO: 6632 - protein, 282 aa, Artificial Sequence
  source: /note="Description of Artificial Sequence: Synthetic polypeptide"
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 6633 - DNA, 847 bp, Artificial Sequence
  source: /note="Description of Artificial Sequence: Synthetic polynucleotide"
aggtggcccgaaagtcccaaggcccaggcatctagtgttcctactgcacagccccaggcagaaggcagcctagccaaagctactactgcacctgccactacgcgcaatactggccgtggcggggaggagaagaaaaaggagaaagagaaagaagaacaggaagagagggagaccaagacccctgaatgtccatcccatacccagccgctgggcgtctatctcttgactcccgcagtacaggacttgtggcttagagataaggccacctttacatgtttcgtcgtgggctctgacctgaaggatgcccatttgacttgggaggttgccggaaaggtacccacagggggggttgaggaagggttgctggagcgccattccaatggctctcagagccagcactcaagactcacccttccgagatccctgtggaacgccgggacctctgtcacatgtactctaaatcatcctagcctgcccccacagcgtctgatggcccttagagagccagccgcccaggcaccagttaagcttagcctgaatctgctcgccagtagtgatcccccagaggccgccagctggctcttatgcgaagtgtccggctttagcccgcccaacatcttgctcatgtggctggaggaccagcgagaagtgaacaccagcggcttcgctccagcccggcccccaccccagccgggttctaccacattctgggcctggagtgtcttaagggtcccagcaccacctagcccccagccagccacatacacctgtgttgtgtcccatgaagatagcaggaccctgctaaatgcttctaggagtctggaggtttcctacgtgactgaccatt

SEQ ID NO: 6634 - protein, 10 aa, Artificial Sequence
  source: /note="Description of Artificial Sequence: Synthetic peptide"
GGGGSGGGGS

SEQ ID NO: 6635 - DNA, 30 bp, Artificial Sequence
  source: /note="Description of Artificial Sequence: Synthetic oligonucleotide"
ggtggcggaggttctggaggtggaggttcc

SEQ ID NO: 6636 - protein, 48 aa, Artificial Sequence
  source: /note="Description of Artificial Sequence: Synthetic polypeptide"
QRRKYRSNKGESPVEPAEPCRYSCPREEEGSTIPIQEDYRKPEPACSP

SEQ ID NO: 6637 - DNA, 123 bp, Artificial Sequence
  source: /note="Description of Artificial Sequence: Synthetic polynucleotide"
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 6638 - DNA, 2000 bp, Artificial Sequence
  source: /note="Description of Artificial Sequence: Synthetic polynucleotide"
  misc_feature (1)..(2000): /note="This sequence may encompass 50-2000 nucleotides"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 6639 - DNA, 1184 bp, Artificial Sequence
  source: /note="Description of Artificial Sequence: Synthetic polynucleotide"
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 6640 - protein, 21 aa, Artificial Sequence
  source: /note="Description of Artificial Sequence: Synthetic peptide"
MALPVTALLLPLALLLHAARP

SEQ ID NO: 6641 - DNA, 63 bp, Artificial Sequence
  source: /note="Description of Artificial Sequence: Synthetic oligonucleotide"
atggccctgcctgtgacagccctgctgctgcctctggctctgctgctgcatgccgctagaccc

SEQ ID NO: 6642 - protein, 45 aa, Artificial Sequence
  source: /note="Description of Artificial Sequence: Synthetic polypeptide"
TTTPAPRPPTPAPTIASQPLSLRPEACRPAAGGAVHTRGLDFACD

SEQ ID NO: 6643 - DNA, 135 bp, Artificial Sequence
  source: /note="Description of Artificial Sequence: Synthetic polynucleotide"
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 6644 - protein, 24 aa, Artificial Sequence
  source: /note="Description of Artificial Sequence: Synthetic peptide"
IYIWAPLAGTCGVLLLSLVITLYC

SEQ ID NO: 6645 - DNA, 72 bp, Artificial Sequence
  source: /note="Description of Artificial Sequence: Synthetic oligonucleotide"
atctacatctgggcgcccttggccgggacttgtggggtccttctcctgtcactggttatcaccctttactgc

SEQ ID NO: 6646 - protein, 42 aa, Artificial Sequence
  source: /note="Description of Artificial Sequence: Synthetic polypeptide"
KRGRKKLLYIFKQPFMRPVQTTQEEDGCSCRFPEEEEGGCEL

SEQ ID NO: 6647 - DNA, 126 bp, Artificial Sequence
  source: /note="Description of Artificial Sequence: Synthetic polynucleotide"
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 6648 - protein, 112 aa, Artificial Sequence
  source: /note="Description of Artificial Sequence: Synthetic polypeptide"
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6649 - DNA, 336 bp, Artificial Sequence
  source: /note="Description of Artificial Sequence: Synthetic polynucleotide"
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 6650 - protein, 112 aa, Artificial Sequence
  source: /note="Description of Artificial Sequence: Synthetic polypeptide"
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6651 - DNA, 336 bp, Artificial Sequence
  source: /note="Description of Artificial Sequence: Synthetic polynucleotide"
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 6652 - protein, 150 aa, Artificial Sequence [sequence omitted]

SEQ ID NO: 6653 - DNA, 450 bp, Artificial Sequence
  source: /note="Description of Artificial Sequence: Synthetic polynucleotide"
cccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtc

SEQ ID NO: 6654 - protein, 394 aa, Artificial Sequence
  source: /note="Description of Artificial Sequence: Synthetic polypeptide"
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6655 - DNA, 1182 bp, Artificial Sequence
  source: /note="Description of Artificial Sequence: Synthetic polynucleotide"
atggccctccctgtcactgccctgcttctccccctcgcactcctgctccacgccgctagaccacccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 6656 - protein, 373 aa, Artificial Sequence
  source: /note="Description of Artificial Sequence: Synthetic polypeptide"
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6657 - RNA, 20 nt, Homo sapiens
ugcagaucccacaggcgccc

SEQ ID NO: 6658 - skipped

SEQ ID NO: 6659 - protein, 4 aa, Artificial Sequence
  source: /note="Description of Artificial Sequence: Synthetic peptide"
RGDS

SEQ ID NO: 6660 - RNA, 74 nt, Artificial Sequence
  source: /note="Description of Artificial Sequence: Synthetic oligonucleotide"
aacagcauagcaaguuaaaauaaggcuaguccguuaucaacuugaaaaaguggcaccgagucggugcuuuuuuu

SEQ ID NO: 6661 - RNA, 74 nt, Artificial Sequence
  source: /note="Description of Artificial Sequence: Synthetic oligonucleotide"
aacagcauagcaaguuuaaauaaggcuaguccguuaucaacuugaaaaaguggcaccgagucggugcuuuuuuu

SEQ ID NO: 6662 - RNA, 20 nt, Homo sapiens
cgcacgcagggcugggcgug

SEQ ID NO: 6663 - RNA, 20 nt, Homo sapiens
gcacgcagggcugggcguga

SEQ ID NO: 6664 - RNA, 20 nt, Homo sapiens
cacgcagggcugggcgugag

SEQ ID NO: 6665 - RNA, 20 nt, Homo sapiens
acgcagggcugggcgugagg

SEQ ID NO: 6666 - RNA, 20 nt, Homo sapiens
gagggggcgugcgcgugcgc

SEQ ID NO: 6667 - RNA, 20 nt, Homo sapiens
cgugcgcaggcgacgcgccg

SEQ ID NO: 6668 - RNA, 20 nt, Homo sapiens
aggcgacgcgccgagguacu

SEQ ID NO: 6669 - RNA, 20 nt, Homo sapiens
cacggcucugccuaguaccu

SEQ ID NO: 6670 - RNA, 20 nt, Homo sapiens
cgagguacuaggcagagccg

SEQ ID NO: 6671 - RNA, 20 nt, Homo sapiens
agagccguggaaccgccgcc

SEQ ID NO: 6672 - RNA, 20 nt, Homo sapiens
gcgaccuggcggcgguucca

SEQ ID NO: 6673 - RNA, 20 nt, Homo sapiens
aaccgccgccaggucgcugu

SEQ ID NO: 6674 - RNA, 20 nt, Homo sapiens
gaccaacagcgaccuggcgg

SEQ ID NO: 6675 - RNA, 20 nt, Homo sapiens
guggaccaacagcgaccugg

SEQ ID NO: 6676 - RNA, 20 nt, Homo sapiens
ggcguggaccaacagcgacc

SEQ ID NO: 6677 - RNA, 20 nt, Homo sapiens
gggcggcgcgacgggcggcg

SEQ ID NO: 6678 - RNA, 20 nt, Homo sapiens
cgggcgggcggcgcgacggg

SEQ ID NO: 6679 - RNA, 20 nt, Homo sapiens
gagcgggcgggcggcgcgac

SEQ ID NO: 6680 - RNA, 20 nt, Homo sapiens
ugagcgggcgggcggcgcga

SEQ ID NO: 6681 - RNA, 20 nt, Homo sapiens
gcggacgcugagcgggcggg

SEQ ID NO: 6682 - RNA, 20 nt, Homo sapiens
gcggcggacgcugagcgggc

SEQ ID NO: 6683 - RNA, 20 nt, Homo sapiens
ggcggcggacgcugagcggg

SEQ ID NO: 6684 - RNA, 20 nt, Homo sapiens
ggcggcggcggacgcugagc

SEQ ID NO: 6685 - RNA, 20 nt, Homo sapiens
uggcggcggcggacgcugag

SEQ ID NO: 6686 - RNA, 20 nt, Homo sapiens
cucagcguccgccgccgcca

SEQ ID NO: 6687 - RNA, 20 nt, Homo sapiens
ucagcguccgccgccgccau

SEQ ID NO: 6688 - RNA, 20 nt, Homo sapiens
cugcacucccauggcggcgg

SEQ ID NO: 6689 - RNA, 20 nt, Homo sapiens
cgccgccgccaugggagugc

SEQ ID NO: 6690 - RNA, 20 nt, Homo sapiens
caccugcacucccauggcgg

SEQ ID NO: 6691 - RNA, 20 nt, Homo sapiens
cgccgccaugggagugcagg

SEQ ID NO: 6692 - RNA, 20 nt, Homo sapiens
uuccaccugcacucccaugg

SEQ ID NO: 6693 - RNA, 20 nt, Homo sapiens
gguuuccaccugcacuccca

SEQ ID NO: 6694 - RNA, 20 nt, Homo sapiens
cagguggaaaccaucucccc

SEQ ID NO: 6695 - RNA, 20 nt, Homo sapiens
cucaccgucuccuggggaga

SEQ ID NO: 6696 - RNA, 20 nt, Homo sapiens
ccacuacucaccgucuccug

SEQ ID NO: 6697 - RNA, 20 nt, Homo sapiens
gccacuacucaccgucuccu

SEQ ID NO: 6698 - RNA, 20 nt, Homo sapiens
cgccacuacucaccgucucc

SEQ ID NO: 6699 - RNA, 20 nt, Homo sapiens
ugcccgucucugucuccuca

SEQ ID NO: 6700 - RNA, 20 nt, Homo sapiens
gggcgcaccuuccccaagcg

SEQ ID NO: 6701 - RNA, 20 nt, Homo sapiens
ggucuggccgcgcuugggga

SEQ ID NO: 6702 - RNA, 20 nt, Homo sapiens
cgcaggucuggccgcgcuug

SEQ ID NO: 6703 - RNA, 20 nt, Homo sapiens
acgcaggucuggccgcgcuu

SEQ ID NO: 6704 - RNA, 20 nt, Homo sapiens
cacgcaggucuggccgcgcu

SEQ ID NO: 6705 - RNA, 20 nt, Homo sapiens
caagcgcggccagaccugcg

SEQ ID NO: 6706 - RNA, 20 nt, Homo sapiens
uguagugcaccacgcagguc

SEQ ID NO: 6707 - RNA, 20 nt, Homo sapiens
accgguguagugcaccacgc

SEQ ID NO: 6708 - RNA, 20 nt, Homo sapiens
ccgcugggcccccgacucac

SEQ ID NO: 6709 - RNA, 20 nt, Homo sapiens
uuacagucgucuuuuucaca

SEQ ID NO: 6710 - RNA, 20 nt, Homo sapiens
uucacagggaugcuugaaga

SEQ ID NO: 6711 - RNA, 20 nt, Homo sapiens
gaaagaaauuugauuccucc

SEQ ID NO: 6712 - RNA, 20 nt, Homo sapiens
aaagaaauuugauuccuccc

SEQ ID NO: 6713 - RNA, 20 nt, Homo sapiens
gggcuuguuucugucccggg

SEQ ID NO: 6714 - RNA, 20 nt, Homo sapiens
aaagggcuuguuucuguccc

SEQ ID NO: 6715 - RNA, 20 nt, Homo sapiens
uaaagggcuuguuucugucc

SEQ ID NO: 6716 - RNA, 20 nt, Homo sapiens
aagcccuuuaaguuuaugcu

SEQ ID NO: 6717 - RNA, 20 nt, Homo sapiens
uugccuagcauaaacuuaaa

SEQ ID NO: 6718 - RNA, 20 nt, Homo sapiens
cuugccuagcauaaacuuaa

SEQ ID NO: 6719 - RNA, 20 nt, Homo sapiens
uaaguuuaugcuaggcaagc

SEQ ID NO: 6720 - RNA, 20 nt, Homo sapiens
guuuaugcuaggcaagcagg

SEQ ID NO: 6721 - RNA, 20 nt, Homo sapiens
ggcaagcaggaggugauccg

SEQ ID NO: 6722 - RNA, 20 nt, Homo sapiens
agcaggaggugauccgaggc

SEQ ID NO: 6723 - RNA, 20 nt, Homo sapiens
gcaggaggugauccgaggcu

SEQ ID NO: 6724 - RNA, 20 nt, Homo sapiens
gugauccgaggcugggaaga

SEQ ID NO: 6725 - RNA, 20 nt, Homo sapiens
ugauccgaggcugggaagaa

SEQ ID NO: 6726 - RNA, 20 nt, Homo sapiens
gauccgaggcugggaagaag

SEQ ID NO: 6727 - RNA, 20 nt, Homo sapiens
caaccccuucuucccagccu

SEQ ID NO: 6728 - RNA, 20 nt, Homo sapiens
acaaaugagagagcauaccu

SEQ ID NO: 6729 - RNA, 20 nt, Homo sapiens
aacaaaugagagagcauacc

SEQ ID NO: 6730 - RNA, 20 nt, Homo sapiens
guucuuuucacagaugagug

SEQ ID NO: 6731 - RNA, 20 nt, Homo sapiens
uucuuuucacagaugagugu

SEQ ID NO: 6732 - RNA, 20 nt, Homo sapiens
aucuggagauauagucaguu

SEQ ID NO: 6733 - RNA, 20 nt, Homo sapiens
auaucuccagauuaugccua

SEQ ID NO: 6734 - RNA, 20 nt, Homo sapiens
guggcaccauaggcauaauc

SEQ ID NO: 6735 - RNA, 20 nt, Homo sapiens
gauuaugccuauggugccac

SEQ ID NO: 6736 - RNA, 20 nt, Homo sapiens
auuaugccuauggugccacu

SEQ ID NO: 6737 - RNA, 20 nt, Homo sapiens
ugggugcccaguggcaccau

SEQ ID NO: 6738 - RNA, 20 nt, Homo sapiens
uauggugccacugggcaccc

SEQ ID NO: 6739 - RNA, 20 nt, Homo sapiens
gaugaugccugggugcccag

SEQ ID NO: 6740 - RNA, 20 nt, Homo sapiens
cauguggugggaugaugccu

SEQ ID NO: 6741 - RNA, 20 nt, Homo sapiens
gcauguggugggaugaugcc

SEQ ID NO: 6742 - RNA, 20 nt, Homo sapiens
agacgagaguggcauguggu

SEQ ID NO: 6743 - RNA, 20 nt, Homo sapiens
aagacgagaguggcaugugg

SEQ ID NO: 6744 - RNA, 20 nt, Homo sapiens
ucgaagacgagaguggcaug

SEQ ID NO: 6745 - RNA, 20 nt, Homo sapiens
ugccacucucgucuucgaug

SEQ ID NO: 6746 - RNA, 20 nt, Homo sapiens
cuccacaucgaagacgagag

SEQ ID NO: 6747 - RNA, 20 nt, Homo sapiens
cgauguggagcuucuaaaac

SEQ ID NO: 6748 - RNA, 20 nt, Homo sapiens
gcuucuaaaacuggaaugac

SEQ ID NO: 6749 - RNA, 20 nt, Homo sapiens
uaaaacuggaaugacaggaa

SEQ ID NO: 6750 - RNA, 25 nt, Homo sapiens
gugaugaggcugugugcuucugagc

SEQ ID NO: 6751 - RNA, 25 nt, Homo sapiens
ugaugaggcugugugcuucugagcu

SEQ ID NO: 6752 - RNA, 25 nt, Homo sapiens
gugugcuucugagcugggcauccga

SEQ ID NO: 6753 - RNA, 25 nt, Homo sapiens
ugagcugggcauccgaaggcauccu

SEQ ID NO: 6754 - RNA, 25 nt, Homo sapiens
gagcugggcauccgaaggcauccuu

SEQ ID NO: 6755 - RNA, 25 nt, Homo sapiens
agcugggcauccgaaggcauccuug

SEQ ID NO: 6756 - RNA, 25 nt, Homo sapiens
uccgaaggcauccuuggggaagcug

SEQ ID NO: 6757 - RNA, 25 nt, Homo sapiens
ccgaaggcauccuuggggaagcuga

SEQ ID NO: 6758 - RNA, 25 nt, Homo sapiens
cauccuuggggaagcugagggcacg

SEQ ID NO: 6759 - RNA, 25 nt, Homo sapiens
ccuuggggaagcugagggcacgagg

SEQ ID NO: 6760 - RNA, 25 nt, Homo sapiens
cuuggggaagcugagggcacgagga

SEQ ID NO: 6761 - RNA, 25 nt, Homo sapiens
uuggggaagcugagggcacgaggag

SEQ ID NO: 6762 - RNA, 25 nt, Homo sapiens
ggcacgaggaggggcugccagacuc

SEQ ID NO: 6763 - RNA, 25 nt, Homo sapiens
gcacgaggaggggcugccagacucc

SEQ ID NO: 6764 - RNA, 25 nt, Homo sapiens
cugccagacuccgggagcugcugcc

SEQ ID NO: 6765 - RNA, 25 nt, Homo sapiens
cagacuccgggagcugcugccuggc

SEQ ID NO: 6766 - RNA, 25 nt, Homo sapiens
agacuccgggagcugcugccuggcu

SEQ ID NO: 6767 - RNA, 25 nt, Homo sapiens
ugggauuccuacacaaugcguugcc

SEQ ID NO: 6768 - RNA, 25 nt, Homo sapiens
ugcguugccuggcuccacgcccugc

SEQ ID NO: 6769 - RNA, 25 nt, Homo sapiens
gcguugccuggcuccacgcccugcu

SEQ ID NO: 6770 - RNA, 25 nt, Homo sapiens
cuggguccuaccugucagagcccca

SEQ ID NO: 6771 - RNA, 25 nt, Homo sapiens
uaccugucagagccccaagguaaaa

SEQ ID NO: 6772 - RNA, 25 nt, Homo sapiens
ugucagagccccaagguaaaaaggc

SEQ ID NO: 6773 - RNA, 25 nt, Homo sapiens
gucagagccccaagguaaaaaggcc

SEQ ID NO: 6774 - RNA, 25 nt, Homo sapiens
ggaguagugauaccagucaccaguu

SEQ ID NO: 6775 - RNA, 25 nt, Homo sapiens
cggaguagugauaccagucaccagu

SEQ ID NO: 6776 - RNA, 25 nt, Homo sapiens
cccucagcuuccccaaggaugccuu

SEQ ID NO: 6777 - RNA, 25 nt, Homo sapiens
ccuccucgugcccucagcuucccca

SEQ ID NO: 6778 - RNA, 25 nt, Homo sapiens
cagccaggcagcagcucccggaguc

SEQ ID NO: 6779 - RNA, 25 nt, Homo sapiens
ggaaucccagccaggcagcagcucc

SEQ ID NO: 6780 - RNA, 25 nt, Homo sapiens
aacgcauuguguaggaaucccagcc

SEQ ID NO: 6781 - RNA, 25 nt, Homo sapiens
cguggagccaggcaacgcauugugu

SEQ ID NO: 6782 - RNA, 25 nt, Homo sapiens
guaggacccagcagggcguggagcc

SEQ ID NO: 6783 - RNA, 25 nt, Homo sapiens
cugacagguaggacccagcagggcg

SEQ ID NO: 6784 - RNA, 25 nt, Homo sapiens
gggcucugacagguaggacccagca

SEQ ID NO: 6785 - RNA, 25 nt, Homo sapiens
ggggcucugacagguaggacccagc

SEQ ID NO: 6786 - RNA, 25 nt, Homo sapiens
uuuuuaccuuggggcucugacaggu

SEQ ID NO: 6787 - RNA, 25 nt, Homo sapiens
ggccuuuuuaccuuggggcucugac

SEQ ID NO: 6788 - RNA, 25 nt, Homo sapiens
ccaggcagcucacagugugccacca

SEQ ID NO: 6789 - RNA, 25 nt, Homo sapiens
agcucacagugugccaccauggagu

SEQ ID NO: 6790 - RNA, 25 nt, Homo sapiens
gcucacagugugccaccauggaguu

SEQ ID NO: 6791 - RNA, 25 nt, Homo sapiens
cucacagugugccaccauggaguug

SEQ ID NO: 6792 - RNA, 25 nt, Homo sapiens
ccaccauggaguuggggccccuaga

SEQ ID NO: 6793 - RNA, 25 nt, Homo sapiens
ccauggaguuggggccccuagaagg

SEQ ID NO: 6794 - RNA, 25 nt, Homo sapiens
uuggggccccuagaagguggcuacc

SEQ ID NO: 6795 - RNA, 25 nt, Homo sapiens
ugccucuaccacuucuaugaccaga

SEQ ID NO: 6796 - RNA, 25 nt, Homo sapiens
uaccacuucuaugaccagauggacc

SEQ ID NO: 6797 - RNA, 25 nt, Homo sapiens
acuucuaugaccagauggaccuggc

SEQ ID NO: 6798 - RNA, 25 nt, Homo sapiens
gagaagaagagauugagcucuacuc

SEQ ID NO: 6799 - RNA, 25 nt, Homo sapiens
aagaagagauugagcucuacucagg

SEQ ID NO: 6800 - RNA, 25 nt, Homo sapiens
agaagagauugagcucuacucaggu

SEQ ID NO: 6801 - RNA, 25 nt, Homo sapiens
cuacucaggugggcccuccucccuc

SEQ ID NO: 6802 - RNA, 25 nt, Homo sapiens
guggcacacugugagcugccuggga

SEQ ID NO: 6803 - RNA, 25 nt, Homo sapiens
gguggcacacugugagcugccuggg

SEQ ID NO: 6804 - RNA, 25 nt, Homo sapiens
caugguggcacacugugagcugccu

SEQ ID NO: 6805 - RNA, 25 nt, Homo sapiens
ccaugguggcacacugugagcugcc

SEQ ID NO: 6806 - RNA, 25 nt, Homo sapiens
ccuucuaggggccccaacuccaugg

SEQ ID NO: 6807 - RNA, 25 nt, Homo sapiens
ccaccuucuaggggccccaacucca

SEQ ID NO: 6808 - RNA, 25 nt, Homo sapiens
gaagcuccagguagccaccuucuag

SEQ ID NO: 6809 - RNA, 25 nt, Homo sapiens
agaagcuccagguagccaccuucua

SEQ ID NO: 6810 - RNA, 25 nt, Homo sapiens
aagaagcuccagguagccaccuucu

SEQ ID NO: 6811 - RNA, 25 nt, Homo sapiens
gucagcaucgcuguuaagaagcucc

SEQ ID NO: 6812 - RNA, 25 nt, Homo sapiens
gucauagaagugguagaggcacagg

SEQ ID NO: 6813 - RNA, 25 nt, Homo sapiens
ggucauagaagugguagaggcacag

SEQ ID NO: 6814 - RNA, 25 nt, Homo sapiens
uggucauagaagugguagaggcaca

SEQ ID NO: 6815 - RNA, 25 nt, Homo sapiens
cuggucauagaagugguagaggcac

SEQ ID NO: 6816 - RNA, 25 nt, Homo sapiens
guccaucuggucauagaagugguag

SEQ ID NO: 6817 - RNA, 25 nt, Homo sapiens
agccagguccaucuggucauagaag

SEQ ID NO: 6818 - RNA, 25 nt, Homo sapiens
cucuucuucuccagccagguccauc

SEQ ID NO: 6819 - RNA, 25 nt, Homo sapiens
gagcucaaucucuucuucuccagcc

SEQ ID NO: 6820 - RNA, 25 nt, Homo sapiens
caccaucaacugcgaccaguucagc

SEQ ID NO: 6821 - RNA, 25 nt, Homo sapiens
caguucagcaggcuguugugugaca

SEQ ID NO: 6822 - RNA, 25 nt, Homo sapiens
ucagcaggcuguugugugacaugga

SEQ ID NO: 6823 - RNA, 25 nt, Homo sapiens
ugacauggaaggugaugaagagacc

SEQ ID NO: 6824 - RNA, 25 nt, Homo sapiens
gacauggaaggugaugaagagacca

SEQ ID NO: 6825 - RNA, 25 nt, Homo sapiens
auggaaggugaugaagagaccaggg

SEQ ID NO: 6826 - RNA, 25 nt, Homo sapiens
agaccagggaggcuuaugccaauau

SEQ ID NO: 6827 - RNA, 25 nt, Homo sapiens
agggaggcuuaugccaauaucggug

SEQ ID NO: 6828 - RNA, 25 nt, Homo sapiens
gauggugucugugucggguucuggg

SEQ ID NO: 6829 - RNA, 25 nt, Homo sapiens
guugauggugucugugucggguucu

SEQ ID NO: 6830 - RNA, 25 nt, Homo sapiens
aguugauggugucugugucggguuc

SEQ ID NO: 6831 - RNA, 25 nt, Homo sapiens
ggucgcaguugauggugucuguguc

SEQ ID NO: 6832 - RNA, 25 nt, Homo sapiens
uggucgcaguugauggugucugugu

SEQ ID NO: 6833 - RNA, 25 nt, Homo sapiens
agccugcugaacuggucgcaguuga

SEQ ID NO: 6834 - RNA, 25 nt, Homo sapiens
caugucacacaacagccugcugaac

SEQ ID NO: 6835 - RNA, 25 nt, Homo sapiens
ucaccgauauuggcauaagccuccc

SEQ ID NO: 6836 - RNA, 25 nt, Homo sapiens
ggcucaggugcuuccucaccgauau

SEQ ID NO: 6837 - RNA, 25 nt, Homo sapiens
cuuuuccuugucugggcagcggaac

SEQ ID NO: 6838 - RNA, 25 nt, Homo sapiens
gcggaacuggaccaguaugucuucc

SEQ ID NO: 6839 - RNA, 25 nt, Homo sapiens
caguaugucuuccaggacucccagc

SEQ ID NO: 6840 - RNA, 25 nt, Homo sapiens
uaugucuuccaggacucccagcugg

SEQ ID NO: 6841 - RNA, 25 nt, Homo sapiens
augucuuccaggacucccagcugga

SEQ ID NO: 6842 - RNA, 25 nt, Homo sapiens
gacucccagcuggagggccugagca

SEQ ID NO: 6843 - RNA, 25 nt, Homo sapiens
agcaaggacauuuucaguaaguuug

SEQ ID NO: 6844 - RNA, 25 nt, Homo sapiens
aaggacauuuucaguaaguuugugg

SEQ ID NO: 6845 - RNA, 25 nt, Homo sapiens
aggacauuuucaguaaguuuguggu

SEQ ID NO: 6846 - RNA, 25 nt, Homo sapiens
acauuuucaguaaguuugugguggg

SEQ ID NO: 6847 - RNA, 25 nt, Homo sapiens
cauuuucaguaaguuuguggugggu

SEQ ID NO: 6848 - RNA, 25 nt, Homo sapiens
cugguccaguuccgcugcccagaca

SEQ ID NO: 6849 - RNA, 25 nt, Homo sapiens
cagcugggaguccuggaagacauac

SEQ ID NO: 6850 - RNA, 25 nt, Homo sapiens
gcucaggcccuccagcugggagucc

SEQ ID NO: 6851 - RNA, 25 nt, Homo sapiens
auguccuugcucaggcccuccagcu

SEQ ID NO: 6852 - RNA, 25 nt, Homo sapiens
aauguccuugcucaggcccuccagc

SEQ ID NO: 6853 - RNA, 25 nt, Homo sapiens
aaacuuacugaaaauguccuugcuc

SEQ ID NO: 6854 - RNA, 25 nt, Homo sapiens
ugguuuuucucaaaguagagcacau

SEQ ID NO: 6855 - RNA, 25 nt, Homo sapiens
agcacauaggaccagaugaagugau

SEQ ID NO: 6856 - RNA, 25 nt, Homo sapiens
ccagaugaagugaucggugagagua

SEQ ID NO: 6857 - RNA, 25 nt, Homo sapiens
agaguauggagaugccagcagaagu

SEQ ID NO: 6858 - RNA, 25 nt, Homo sapiens
gaguauggagaugccagcagaaguu

SEQ ID NO: 6859 - RNA, 25 nt, Homo sapiens
ccauacucucaccgaucacuucauc

SEQ ID NO: 6860 - RNA, 25 nt, Homo sapiens
ucugacuuuucugcccaacuucugc

SEQ ID NO: 6861 - RNA, 25 nt, Homo sapiens
cauguuuucucugcagccuucccag

SEQ ID NO: 6862 - RNA, 25 nt, Homo sapiens
ucugcagccuucccagaggagcuuc

SEQ ID NO: 6863 - RNA, 25 nt, Homo sapiens
ggagcuuccggcagaccugaagcac

SEQ ID NO: 6864 - RNA, 25 nt, Homo sapiens
cggcagaccugaagcacuggaagcc

SEQ ID NO: 6865 - RNA, 25 nt, Homo sapiens
cugaagcacuggaagccaggugugc

SEQ ID NO: 6866 - RNA, 25 nt, Homo sapiens
ugaagcacuggaagccaggugugca

SEQ ID NO: 6867 - RNA, 25 nt, Homo sapiens
gcacuggaagccaggugugcagggc

SEQ ID NO: 6868 - RNA, 25 nt, Homo sapiens
cuggaagccaggugugcagggcagg

SEQ ID NO: 6869 - RNA, 25 nt, Homo sapiens
uggaagccaggugugcagggcaggu

SEQ ID NO: 6870 - RNA, 25 nt, Homo sapiens
aggucugccggaagcuccucuggga

SEQ ID NO: 6871 - RNA, 25 nt, Homo sapiens
cuucaggucugccggaagcuccucu

SEQ ID NO: 6872 - RNA, 25 nt, Homo sapiens
gcuucaggucugccggaagcuccuc

SEQ ID NO: 6873 - RNA, 25 nt, Homo sapiens
cuggcuuccagugcuucaggucugc

SEQ ID NO: 6874 - RNA, 25 nt, Homo sapiens
cugcacaccuggcuuccagugcuuc

SEQ ID NO: 6875 - RNA, 25 nt, Homo sapiens
uuccucacagcugagccccccacug

SEQ ID NO: 6876 - RNA, 25 nt, Homo sapiens
cagcugagccccccacuguggugac

SEQ ID NO: 6877 - RNA, 25 nt, Homo sapiens
acuguggugacuggcagucuccuag

SEQ ID NO: 6878 - RNA, 25 nt, Homo sapiens
cuguggugacuggcagucuccuagu

SEQ ID NO: 6879 - RNA, 25 nt, Homo sapiens
cugccacugccugcgcuguucaacc

SEQ ID NO: 6880 - RNA, 25 nt, Homo sapiens
cgcuguucaaccaggagccagccuc

SEQ ID NO: 6881 - RNA, 25 nt, Homo sapiens
gagccagccuccggccagaugcgcc

SEQ ID NO: 6882 - RNA, 25 nt, Homo sapiens
aaaccgaccagauucccaguauguu

SEQ ID NO: 6883 - RNA, 25 nt, Homo sapiens
aaccgaccagauucccaguauguua

SEQ ID NO: 6884 - RNA, 25 nt, Homo sapiens
accgaccagauucccaguauguuag

SEQ ID NO: 6885 - RNA, 25 nt, Homo sapiens
ccgaccagauucccaguauguuagg

SEQ ID NO: 6886 - RNA, 25 nt, Homo sapiens
cagauucccaguauguuagggggcu

SEQ ID NO: 6887 - RNA, 25 nt, Homo sapiens
guggggggcucagcugugaggaagu

SEQ ID NO: 6888 - RNA, 25 nt, Homo sapiens
aguggggggcucagcugugaggaag

SEQ ID NO: 6889 - RNA, 25 nt, Homo sapiens
caccacaguggggggcucagcugug

SEQ ID NO: 6890 - RNA, 25 nt, Homo sapiens
ggagacugccagucaccacaguggg

SEQ ID NO: 6891 - RNA, 25 nt, Homo sapiens
aggagacugccagucaccacagugg

SEQ ID NO: 6892 - RNA, 25 nt, Homo sapiens
uaggagacugccagucaccacagug

SEQ ID NO: 6893 - RNA, 25 nt, Homo sapiens
cuaggagacugccagucaccacagu

SEQ ID NO: 6894 - RNA, 25 nt, Homo sapiens
acuaggagacugccagucaccacag

SEQ ID NO: 6895 - RNA, 25 nt, Homo sapiens
ggagcagucgcucacuggucccacu

SEQ ID NO: 6896 - RNA, 25 nt, Homo sapiens
agggcaggguggagcagucgcucac

SEQ ID NO: 6897 - RNA, 25 nt, Homo sapiens
gcaggcaguggcaggcagggcaggg

SEQ ID NO: 6898 - RNA, 25 nt, Homo sapiens
agcgcaggcaguggcaggcagggca

SEQ ID NO: 6899 - RNA, 25 nt, Homo sapiens
cagcgcaggcaguggcaggcagggc

SEQ ID NO: 6900 - RNA, 25 nt, Homo sapiens
ugaacagcgcaggcaguggcaggca

SEQ ID NO: 6901 - RNA, 25 nt, Homo sapiens
uugaacagcgcaggcaguggcaggc

SEQ ID NO: 6902 - RNA, 25 nt, Homo sapiens
cugguugaacagcgcaggcaguggc

SEQ ID NO: 6903 - RNA, 25 nt, Homo sapiens
gcuccugguugaacagcgcaggcag

SEQ ID NO: 6904 - RNA, 25 nt, Homo sapiens
aggcuggcuccugguugaacagcgc

SEQ ID NO: 6905 - RNA, 25 nt, Homo sapiens
gcgcaucuggccggaggcuggcucc

SEQ ID NO: 6906 - RNA, 25 nt, Homo sapiens
ucuccaggcgcaucuggccggaggc

SEQ ID NO: 6907 - RNA, 25 nt, Homo sapiens
guuuucuccaggcgcaucuggccgg

SEQ ID NO: 6908 - RNA, 25 nt, Homo sapiens
ucgguuuucuccaggcgcaucuggc

SEQ ID NO: 6909 - RNA, 25 nt, Homo sapiens
cuggucgguuuucuccaggcgcauc

SEQ ID NO: 6910 - RNA, 25 nt, Homo sapiens
acugggaaucuggucgguuuucucc

SEQ ID NO: 6911 - RNA, 25 nt, Homo sapiens
cccccuaacauacugggaaucuggu

SEQ ID NO: 6912 - RNA, 25 nt, Homo sapiens
caagcccccuaacauacugggaauc

SEQ ID NO: 6913 - RNA, 25 nt, Homo sapiens
ucguugagcugccugaaucucccug

SEQ ID NO: 6914 - RNA, 25 nt, Homo sapiens
cguugagcugccugaaucucccuga

SEQ ID NO: 6915 - RNA, 25 nt, Homo sapiens
uccccaccaucuccacucugcccca

SEQ ID NO: 6916 - RNA, 25 nt, Homo sapiens
ccccaccaucuccacucugccccau

SEQ ID NO: 6917 - RNA, 25 nt, Homo sapiens
caucuccacucugccccaugggcuc

SEQ ID NO: 6918 - RNA, 25 nt, Homo sapiens
ccccaugggcucuggcaaaucucug

SEQ ID NO: 6919 - RNA, 25 nt, Homo sapiens
augggcucuggcaaaucucugaggc

SEQ ID NO: 6920 - RNA, 25 nt, Homo sapiens
ucuggcaaaucucugaggcuggaac

SEQ ID NO: 6921 - RNA, 25 nt, Homo sapiens
cuggcaaaucucugaggcuggaaca

SEQ ID NO: 6922 - RNA, 25 nt, Homo sapiens
uggcaaaucucugaggcuggaacag

SEQ ID NO: 6923 - RNA, 25 nt, Homo sapiens
gggucuccaguauauucaucuacca

SEQ ID NO: 6924 - RNA, 25 nt, Homo sapiens
guauauucaucuaccauggugagug

SEQ ID NO: 6925 - RNA, 25 nt, Homo sapiens
uauauucaucuaccauggugagugc

SEQ ID NO: 6926 - RNA, 25 nt, Homo sapiens
auauucaucuaccauggugagugcg

SEQ ID NO: 6927 - RNA, 25 nt, Homo sapiens
caucuaccauggugagugcggggcc

SEQ ID NO: 6928 - RNA, 25 nt, Homo sapiens
uggagaaaggcacugcaagagacaa

SEQ ID NO: 6929 - RNA, 25 nt, Homo sapiens
ggcagcucaacgaggaacuggagaa

SEQ ID NO: 6930 - RNA, 25 nt, Homo sapiens
agauucaggcagcucaacgaggaac

SEQ ID NO: 6931 - RNA, 25 nt, Homo sapiens
ucagggagauucaggcagcucaacg

SEQ ID NO: 6932 - RNA, 25 nt, Homo sapiens
cuggaugggucccucagggagauuc

SEQ ID NO: 6933 - RNA, 25 nt, Homo sapiens
ggggacaaacuggaugggucccuca

SEQ ID NO: 6934 - RNA, 25 nt, Homo sapiens
uggggacaaacuggaugggucccuc

SEQ ID NO: 6935 - RNA, 25 nt, Homo sapiens
uggagaugguggggacaaacuggau

SEQ ID NO: 6936 - RNA, 25 nt, Homo sapiens
guggagaugguggggacaaacugga

SEQ ID NO: 6937 - RNA, 25 nt, Homo sapiens
cagaguggagaugguggggacaaac

SEQ ID NO: 6938 - RNA, 25 nt, Homo sapiens
cccauggggcagaguggagauggug

SEQ ID NO: 6939 - RNA, 25 nt, Homo sapiens
gcccauggggcagaguggagauggu

SEQ ID NO: 6940 - RNA, 25 nt, Homo sapiens
agcccauggggcagaguggagaugg

SEQ ID NO: 6941 - RNA, 25 nt, Homo sapiens
cagagcccauggggcagaguggaga

SEQ ID NO: 6942 - RNA, 25 nt, Homo sapiens
auuugccagagcccauggggcagag

SEQ ID NO: 6943 - RNA, 25 nt, Homo sapiens
ccucagagauuugccagagcccaug

SEQ ID NO: 6944 - RNA, 25 nt, Homo sapiens
gccucagagauuugccagagcccau

SEQ ID NO: 6945 - RNA, 25 nt, Homo sapiens
agccucagagauuugccagagccca

SEQ ID NO: 6946 - RNA, 25 nt, Homo sapiens
cacucaccaugguagaugaauauac

SEQ ID NO: 6947 - RNA, 25 nt, Homo sapiens
acccccaauguaggugaggugcccc

SEQ ID NO: 6948 - RNA, 25 nt, Homo sapiens
aggccagccaaguacccccucccag

SEQ ID NO: 6949 - RNA, 25 nt, Homo sapiens
ccccucccaguggauucacugucca

SEQ ID NO: 6950 - RNA, 25 nt, Homo sapiens
ccacggccucccaacaucuccagac

SEQ ID NO: 6951 - RNA, 25 nt, Homo sapiens
gccucccaacaucuccagaccggcc

SEQ ID NO: 6952 - RNA, 25 nt, Homo sapiens
cccugaccucccgagcaaacaugac

SEQ ID NO: 6953 - RNA, 25 nt, Homo sapiens
accucccgagcaaacaugacaggua

SEQ ID NO: 6954 - RNA, 25 nt, Homo sapiens
gcaaacaugacagguaaggacccuu

SEQ ID NO: 6955 - RNA, 25 nt, Homo sapiens
caaacaugacagguaaggacccuua

SEQ ID NO: 6956 - RNA, 25 nt, Homo sapiens
uggggcaccucaccuacauuggggg

SEQ ID NO: 6957 - RNA, 25 nt, Homo sapiens
gccuggggcaccucaccuacauugg

SEQ ID NO: 6958 - RNA, 25 nt, Homo sapiens
ggccuggggcaccucaccuacauug

SEQ ID NO: 6959 - RNA, 25 nt, Homo sapiens
uggccuggggcaccucaccuacauu

SEQ ID NO: 6960 - RNA, 25 nt, Homo sapiens
cuggccuggggcaccucaccuacau

SEQ ID NO: 6961 - RNA, 25 nt, Homo sapiens
ugggaggggguacuuggcuggccug

SEQ ID NO: 6962 - RNA, 25 nt, Homo sapiens
cugggaggggguacuuggcuggccu

SEQ ID NO: 6963 - RNA, 25 nt, Homo sapiens
acugggaggggguacuuggcuggcc

SEQ ID NO: 6964 - RNA, 25 nt, Homo sapiens
aauccacugggaggggguacuuggc

SEQ ID NO: 6965 - RNA, 25 nt, Homo sapiens
agugaauccacugggaggggguacu

SEQ ID NO: 6966 - RNA, 25 nt, Homo sapiens
cguggacagugaauccacugggagg

SEQ ID NO: 6967 - RNA, 25 nt, Homo sapiens
ccguggacagugaauccacugggag

SEQ ID NO: 6968 - RNA, 25 nt, Homo sapiens
gccguggacagugaauccacuggga

SEQ ID NO: 6969 - RNA, 25 nt, Homo sapiens
ggccguggacagugaauccacuggg

SEQ ID NO: 6970 - RNA, 25 nt, Homo sapiens
ggaggccguggacagugaauccacu

SEQ ID NO: 6971 - RNA, 25 nt, Homo sapiens
gggaggccguggacagugaauccac

SEQ ID NO: 6972 - RNA, 25 nt, Homo sapiens
ccggucuggagauguugggaggccg

SEQ ID NO: 6973 - RNA, 25 nt, Homo sapiens
gccuggccggucuggagauguuggg

SEQ ID NO: 6974 - RNA, 25 nt, Homo sapiens
ggagccuggccggucuggagauguu

SEQ ID NO: 6975 - RNA, 25 nt, Homo sapiens
uggagccuggccggucuggagaugu

SEQ ID NO: 6976 - RNA, 25 nt, Homo sapiens
aggggcugguggagccuggccgguc

SEQ ID NO: 6977 - RNA, 25 nt, Homo sapiens
agcgaaggggcugguggagccuggc

SEQ ID NO: 6978 - RNA, 25 nt, Homo sapiens
auggagcgaaggggcugguggagcc

SEQ ID NO: 6979 - RNA, 25 nt, Homo sapiens
cuggcugauggagcgaaggggcugg

SEQ ID NO: 6980 - RNA, 25 nt, Homo sapiens
agucuggcugauggagcgaaggggc

SEQ ID NO: 6981 - RNA, 25 nt, Homo sapiens
guccagucuggcugauggagcgaag

SEQ ID NO: 6982 - RNA, 25 nt, Homo sapiens
cguccagucuggcugauggagcgaa

SEQ ID NO: 6983 - RNA, 25 nt, Homo sapiens
ccguccagucuggcugauggagcga

SEQ ID NO: 6984 - RNA, 25 nt, Homo sapiens
cguacgacccguccagucuggcuga

SEQ ID NO: 6985 - RNA, 25 nt, Homo sapiens
ccaaguccguacgacccguccaguc

SEQ ID NO: 6986 - RNA, 25 nt, Homo sapiens
ggguccuuaccugucauguuugcuc

SEQ ID NO: 6987 - RNA, 25 nt, Homo sapiens
aggguccuuaccugucauguuugcu

SEQ ID NO: 6988 - RNA, 25 nt, Homo sapiens
cacaagacgucccccacccaaugcc

SEQ ID NO: 6989 - RNA, 25 nt, Homo sapiens
cgucccccacccaaugcccggcagc

SEQ ID NO: 6990 - RNA, 25 nt, Homo sapiens
cccacccaaugcccggcagcuggag

SEQ ID NO: 6991 - RNA, 25 nt, Homo sapiens
agaggucuccaacaagcuuccaaaa

SEQ ID NO: 6992 - RNA, 25 nt, Homo sapiens
ucuccaacaagcuuccaaaauggcc

SEQ ID NO: 6993 - RNA, 25 nt, Homo sapiens
uuccaaaauggccuggugagugaug

SEQ ID NO: 6994 - RNA, 25 nt, Homo sapiens
uccaaaauggccuggugagugaugc

SEQ ID NO: 6995 - RNA, 25 nt, Homo sapiens
ucuugugcucuggagauggagaagc

SEQ ID NO: 6996 - RNA, 25 nt, Homo sapiens
ugggggacgucuugugcucuggaga

SEQ ID NO: 6997 - RNA, 25 nt, Homo sapiens
auugggugggggacgucuugugcuc

SEQ ID NO: 6998 - RNA, 25 nt, Homo sapiens
ucuccagcugccgggcauugggugg

SEQ ID NO: 6999 - RNA, 25 nt, Homo sapiens
cucuccagcugccgggcauugggug

SEQ ID NO: 7000 - RNA, 25 nt, Homo sapiens
ccucuccagcugccgggcauugggu

SEQ ID NO: 7001 - RNA, 25 nt, Homo sapiens
accucuccagcugccgggcauuggg

SEQ ID NO: 7002 - RNA, 25 nt, Homo sapiens
gagaccucuccagcugccgggcauu

SEQ ID NO: 7003 - RNA, 25 nt, Homo sapiens
ggagaccucuccagcugccgggcau

SEQ ID NO: 7004 - RNA, 25 nt, Homo sapiens
cuuguuggagaccucuccagcugcc

SEQ ID NO: 7005 - RNA, 25 nt, Homo sapiens
gcuuguuggagaccucuccagcugc

SEQ ID NO: 7006 - RNA, 25 nt, Homo sapiens
ucaccaggccauuuuggaagcuugu

SEQ ID NO: 7007 - RNA, 25 nt, Homo sapiens
ucccgcaucacucaccaggccauuu

SEQ ID NO: 7008 - RNA, 25 nt, Homo sapiens
acgccccuggccuuugcagagccgg

SEQ ID NO: 7009 - RNA, 25 nt, Homo sapiens
guggagcaguucuaccgcucacugc

SEQ ID NO: 7010 - RNA, 25 nt, Homo sapiens
ucuaccgcucacugcaggacacgua

SEQ ID NO: 7011 - RNA, 25 nt, Homo sapiens
aggacacguauggugccgagcccgc

SEQ ID NO: 7012 - RNA, 25 nt, Homo sapiens
acguauggugccgagcccgcaggcc

SEQ ID NO: 7013 - RNA, 25 nt, Homo sapiens
auggugccgagcccgcaggcccgga

SEQ ID NO: 7014 - RNA, 25 nt, Homo sapiens
agccuggagcgggaacuggccaccc

SEQ ID NO: 7015 - RNA, 25 nt, Homo sapiens
ggagcgggaacuggccaccccggac

SEQ ID NO: 7016 - RNA, 25 nt, Homo sapiens
gagcgggaacuggccaccccggacu

SEQ ID NO: 7017 - RNA, 25 nt, Homo sapiens
acuggccaccccggacugggcagaa

SEQ ID NO: 7018 - RNA, 25 nt, Homo sapiens
accccggacugggcagaacggcagc

SEQ ID NO: 7019 - RNA, 25 nt, Homo sapiens
acugggcagaacggcagcuggccca

SEQ ID NO: 7020 - RNA, 25 nt, Homo sapiens
gggcagaacggcagcuggcccaagg

SEQ ID NO: 7021 - RNA, 25 nt, Homo sapiens
gaacggcagcuggcccaaggaggcc

SEQ ID NO: 7022 - RNA, 25 nt, Homo sapiens
cagcuggcccaaggaggccuggcug

SEQ ID NO: 7023 - RNA, 25 nt, Homo sapiens
caaggaggccuggcugaggugcugu

SEQ ID NO: 7024 - RNA, 25 nt, Homo sapiens
cuggcugaggugcuguuggcugcca

SEQ ID NO: 7025 - RNA, 25 nt, Homo sapiens
ggugcuguuggcugccaaggagcac

SEQ ID NO: 7026 - RNA, 25 nt, Homo sapiens
gcuguuggcugccaaggagcaccgg

SEQ ID NO: 7027 - RNA, 25 nt, Homo sapiens
cgugagacacgagugauugcugugc

SEQ ID NO: 7028 - RNA, 25 nt, Homo sapiens
gugagacacgagugauugcugugcu

SEQ ID NO: 7029 - RNA, 25 nt, Homo sapiens
gagugauugcugugcugggcaaagc

SEQ ID NO: 7030 - RNA, 25 nt, Homo sapiens
auugcugugcugggcaaagcugguc

SEQ ID NO: 7031 - RNA, 25 nt, Homo sapiens
uugcugugcugggcaaagcugguca

SEQ ID NO: 7032 - RNA, 25 nt, Homo sapiens
caaagcuggucagggcaagagcuau

SEQ ID NO: 7033 - RNA, 25 nt, Homo sapiens
aaagcuggucagggcaagagcuauu

SEQ ID NO: 7034 - RNA, 25 nt, Homo sapiens
cuggucagggcaagagcuauugggc

SEQ ID NO: 7035 - RNA, 25 nt, Homo sapiens
uggucagggcaagagcuauugggcu

SEQ ID NO: 7036 - RNA, 25 nt, Homo sapiens
ggucagggcaagagcuauugggcug

SEQ ID NO: 7037 - RNA, 25 nt, Homo sapiens
gagcuauugggcuggggcagugagc

SEQ ID NO: 7038 - RNA, 25 nt, Homo sapiens
agcuauugggcuggggcagugagcc

SEQ ID NO: 7039 - RNA, 25 nt, Homo sapiens
uugggcuggggcagugagccgggcc

SEQ ID NO: 7040 - RNA, 25 nt, Homo sapiens
ugggcuggggcagugagccgggccu

SEQ ID NO: 7041 - RNA, 25 nt, Homo sapiens
gggcagugagccgggccugggcuug

SEQ ID NO: 7042 - RNA, 25 nt, Homo sapiens
agugagccgggccugggcuuguggc

SEQ ID NO: 7043 - RNA, 25 nt, Homo sapiens
guccccugccauugcuugaaccguc

SEQ ID NO: 7044 - RNA, 25 nt, Homo sapiens
uccccugccauugcuugaaccgucc

SEQ ID NO: 7045 - RNA, 25 nt, Homo sapiens
ccccugccauugcuugaaccguccg

SEQ ID NO: 7046 - RNA, 25 nt, Homo sapiens
cccugccauugcuugaaccguccgg

SEQ ID NO: 7047 - RNA, 25 nt, Homo sapiens
gcuugaaccguccgggggaugccua

SEQ ID NO: 7048 - RNA, 25 nt, Homo sapiens
cguccgggggaugccuauggccugc

SEQ ID NO: 7049 - RNA, 25 nt, Homo sapiens
ggccugcaggaucugcucuucuccc

SEQ ID NO: 7050 - RNA, 25 nt, Homo sapiens
gccugcaggaucugcucuucucccu

SEQ ID NO: 7051 - RNA, 25 nt, Homo sapiens
uucucccugggcccacagccacucg

SEQ ID NO: 7052 - RNA, 25 nt, Homo sapiens
ucccugggcccacagccacucgugg

SEQ ID NO: 7053 - RNA, 25 nt, Homo sapiens
ccacagccacucguggcggccgaug

SEQ ID NO: 7054 - RNA, 25 nt, Homo sapiens
cugaccgcguucugcucauccuaga

SEQ ID NO: 7055 - RNA, 25 nt, Homo sapiens
guucugcucauccuagacggcuucg

SEQ ID NO: 7056 - RNA, 25 nt, Homo sapiens
cucauccuagacggcuucgaggagc

SEQ ID NO: 7057 - RNA, 25 nt, Homo sapiens
gcuucgaggagcuggaagcgcaaga

SEQ ID NO: 7058 - RNA, 25 nt, Homo sapiens
aagauggcuuccugcacagcacgug

SEQ ID NO: 7059 - RNA, 25 nt, Homo sapiens
ggcuuccugcacagcacgugcggac

SEQ ID NO: 7060 - RNA, 25 nt, Homo sapiens
cugcacagcacgugcggaccggcac

SEQ ID NO: 7061 - RNA, 25 nt, Homo sapiens
cacagcacgugcggaccggcaccgg

SEQ ID NO: 7062 - RNA, 25 nt, Homo sapiens
ggcaccggcggagcccugcucccuc

SEQ ID NO: 7063 - RNA, 25 nt, Homo sapiens
gcaccggcggagcccugcucccucc

SEQ ID NO: 7064 - RNA, 25 nt, Homo sapiens
caccggcggagcccugcucccuccg

SEQ ID NO: 7065 - RNA, 25 nt, Homo sapiens
accggcggagcccugcucccuccgg

SEQ ID NO: 7066 - RNA, 25 nt, Homo sapiens
gagcccugcucccuccgggggcugc

SEQ ID NO: 7067 - RNA, 25 nt, Homo sapiens
ccugcucccuccgggggcugcuggc

SEQ ID NO: 7068 - RNA, 25 nt, Homo sapiens
gccuuuuccagaagaagcugcuccg

SEQ ID NO: 7069 - RNA, 25 nt, Homo sapiens
agguugcacccuccuccucacagcc

SEQ ID NO: 7070 - RNA, 25 nt, Homo sapiens
cacccuccuccucacagcccggccc

SEQ ID NO: 7071 - RNA, 25 nt, Homo sapiens
acccuccuccucacagcccggcccc

SEQ ID NO: 7072 - RNA, 25 nt, Homo sapiens
cccuccuccucacagcccggccccg

SEQ ID NO: 7073 - RNA, 25 nt, Homo sapiens
cucacagcccggccccggggccgcc

SEQ ID NO: 7074 - RNA, 25 nt, Homo sapiens
ggccgccugguccagagccugagca

SEQ ID NO: 7075 - RNA, 25 nt, Homo sapiens
aggccgacgcccuauuugagcuguc

SEQ ID NO: 7076 - RNA, 25 nt, Homo sapiens
cuauuugagcuguccggcuucucca

SEQ ID NO: 7077 - RNA, 25 nt, Homo sapiens
gagcuguccggcuucuccauggagc

SEQ ID NO: 7078 - RNA, 25 nt, Homo sapiens
uccggcuucuccauggagcaggccc

SEQ ID NO: 7079 - RNA, 25 nt, Homo sapiens
acgugaugcgcuacuuugagagcuc

SEQ ID NO: 7080 - RNA, 25 nt, Homo sapiens
cgugaugcgcuacuuugagagcuca

SEQ ID NO: 7081 - RNA, 25 nt, Homo sapiens
ccaagacagagcccugacgcuccuc

SEQ ID NO: 7082 - RNA, 25 nt, Homo sapiens
caagacagagcccugacgcuccucc

SEQ ID NO: 7083 - RNA, 25 nt, Homo sapiens
cagagcccugacgcuccuccgggac

SEQ ID NO: 7084 - RNA, 25 nt, Homo sapiens
ucacagccacagcccuacuuugugc

SEQ ID NO: 7085 - RNA, 25 nt, Homo sapiens
cacagccacagcccuacuuugugcc

SEQ ID NO: 7086 - RNA, 25 nt, Homo sapiens
ugccgggcagugugccagcucucag

SEQ ID NO: 7087 - RNA, 25 nt, Homo sapiens
gugugccagcucucagaggcccugc

SEQ ID NO: 7088 - RNA, 25 nt, Homo sapiens
agcucucagaggcccugcuggagcu

SEQ ID NO: 7089 - RNA, 25 nt, Homo sapiens
gcucucagaggcccugcuggagcuu

SEQ ID NO: 7090 - RNA, 25 nt, Homo sapiens
cucucagaggcccugcuggagcuug

SEQ ID NO: 7091 - RNA, 25 nt, Homo sapiens
ucagaggcccugcuggagcuugggg

SEQ ID NO: 7092 - RNA, 25 nt, Homo sapiens
gacgccaagcugcccuccacgcuca

SEQ ID NO: 7093 - RNA, 25 nt, Homo sapiens
acgccaagcugcccuccacgcucac

SEQ ID NO: 7094 - RNA, 25 nt, Homo sapiens
ccuccacgcucacgggacucuaugu

SEQ ID NO: 7095 - RNA, 25 nt, Homo sapiens
cucacgggacucuaugucggccugc

SEQ ID NO: 7096 - RNA, 25 nt, Homo sapiens
ucacgggacucuaugucggccugcu

SEQ ID NO: 7097 - RNA, 25 nt, Homo sapiens
gccgugcagcccucgacagcccccc

SEQ ID NO: 7098 - RNA, 25 nt, Homo sapiens
ccgugcagcccucgacagccccccc

SEQ ID NO: 7099 - RNA, 25 nt, Homo sapiens
cgugcagcccucgacagcccccccg

SEQ ID NO: 7100 - RNA, 25 nt, Homo sapiens
gcccucgacagcccccccggggccc

SEQ ID NO: 7101 - RNA, 25 nt, Homo sapiens
agcccccccggggcccuggcagagc

SEQ ID NO: 7102 - RNA, 25 nt, Homo sapiens
ggggcccuggcagagcuggccaagc

SEQ ID NO: 7103 - RNA, 25 nt, Homo sapiens
ccuggcagagcuggccaagcuggcc

SEQ ID NO: 7104 - RNA, 25 nt, Homo sapiens
cuggcagagcuggccaagcuggccu

SEQ ID NO: 7105 - RNA, 25 nt, Homo sapiens
gagcuggccaagcuggccugggagc

SEQ ID NO: 7106 - RNA, 25 nt, Homo sapiens
agcuggccaagcuggccugggagcu

SEQ ID NO: 7107 - RNA, 25 nt, Homo sapiens
ggccgcagacaucaaaguacccuac

SEQ ID NO: 7108 - RNA, 25 nt, Homo sapiens
cgcagacaucaaaguacccuacagg

SEQ ID NO: 7109 - RNA, 25 nt, Homo sapiens
ggaccaguucccauccgcagacgug

SEQ ID NO: 7110 - RNA, 25 nt, Homo sapiens
guucccauccgcagacgugaggacc

SEQ ID NO: 7111 - RNA, 25 nt, Homo sapiens
uucccauccgcagacgugaggaccu

SEQ ID NO: 7112 - RNA, 25 nt, Homo sapiens
uccgcagacgugaggaccugggcga

SEQ ID NO: 7113 - RNA, 25 nt, Homo sapiens
acgugaggaccugggcgauggccaa

SEQ ID NO: 7114 - RNA, 25 nt, Homo sapiens
caaaggcuuaguccaacacccaccg

SEQ ID NO: 7115 - RNA, 25 nt, Homo sapiens
aaaggcuuaguccaacacccaccgc

SEQ ID NO: 7116 - RNA, 25 nt, Homo sapiens
ccaccgcgggccgcagaguccgagc

SEQ ID NO: 7117 - RNA, 25 nt, Homo sapiens
cccagcuuccuccugcaaugcuucc

SEQ ID NO: 7118 - RNA, 25 nt, Homo sapiens
ccagcuuccuccugcaaugcuuccu

SEQ ID NO: 7119 - RNA, 25 nt, Homo sapiens
cagcuuccuccugcaaugcuuccug

SEQ ID NO: 7120 - RNA, 25 nt, Homo sapiens
agcuuccuccugcaaugcuuccugg

SEQ ID NO: 7121 - RNA, 25 nt, Homo sapiens
ccugcaaugcuuccugggggcccug

SEQ ID NO: 7122 - RNA, 25 nt, Homo sapiens
caaugcuuccugggggcccuguggc

SEQ ID NO: 7123 - RNA, 25 nt, Homo sapiens
ugggggcccuguggcuggcucugag

SEQ ID NO: 7124 - RNA, 25 nt, Homo sapiens
uggcuggcucugaguggcgaaauca

SEQ ID NO: 7125 - RNA, 25 nt, Homo sapiens
gcucugaguggcgaaaucaaggaca

SEQ ID NO: 7126 - RNA, 25 nt, Homo sapiens
cccgcaguaccuagcauugacccca

SEQ ID NO: 7127 - RNA, 25 nt, Homo sapiens
ccuagcauugaccccaaggaagaag

SEQ ID NO: 7128 - RNA, 25 nt, Homo sapiens
aaggaagaagaggcccuaugacaac

SEQ ID NO: 7129 - RNA, 25 nt, Homo sapiens
aagaagaggcccuaugacaacuggc

SEQ ID NO: 7130 - RNA, 25 nt, Homo sapiens
aagaggcccuaugacaacuggcugg

SEQ ID NO: 7131 - RNA, 25 nt, Homo sapiens
agaggcccuaugacaacuggcugga

SEQ ID NO: 7132 - RNA, 25 nt, Homo sapiens
uggcuggagggcgugccacgcuuuc

SEQ ID NO: 7133 - RNA, 25 nt, Homo sapiens
uggagggcgugccacgcuuucuggc

SEQ ID NO: 7134 - RNA, 25 nt, Homo sapiens
ggagggcgugccacgcuuucuggcu

SEQ ID NO: 7135 - RNA, 25 nt, Homo sapiens
aucuuccagccucccgcccgcugcc

SEQ ID NO: 7136 - RNA, 25 nt, Homo sapiens
ucuuccagccucccgcccgcugccu

SEQ ID NO: 7137 - RNA, 25 nt, Homo sapiens
ccgcccgcugccugggagcccuacu

SEQ ID NO: 7138 - RNA, 25 nt, Homo sapiens
cgcccgcugccugggagcccuacuc

SEQ ID NO: 7139 - RNA, 25 nt, Homo sapiens
ugccugggagcccuacucgggccau

SEQ ID NO: 7140 - RNA, 25 nt, Homo sapiens
cugggagcccuacucgggccaucgg

SEQ ID NO: 7141 - RNA, 25 nt, Homo sapiens
cuacucgggccaucggcggcugccu

SEQ ID NO: 7142 - RNA, 25 nt, Homo sapiens
cucgggccaucggcggcugccucgg

SEQ ID NO: 7143 - RNA, 25 nt, Homo sapiens
gccaucggcggcugccucgguggac

SEQ ID NO: 7144 - RNA, 25 nt, Homo sapiens
gcugccucgguggacaggaagcaga

SEQ ID NO: 7145 - RNA, 25 nt, Homo sapiens
ggacaggaagcagaaggugcuugcg

SEQ ID NO: 7146 - RNA, 25 nt, Homo sapiens
gaaggugcuugcgagguaccugaag

SEQ ID NO: 7147 - RNA, 25 nt, Homo sapiens
gcgagguaccugaagcggcugcagc

SEQ ID NO: 7148 - RNA, 25 nt, Homo sapiens
cgagguaccugaagcggcugcagcc

SEQ ID NO: 7149 - RNA, 25 nt, Homo sapiens
gagguaccugaagcggcugcagccg

SEQ ID NO: 7150 - RNA, 25 nt, Homo sapiens
gaagcggcugcagccggggacacug

SEQ ID NO: 7151 - RNA, 25 nt, Homo sapiens
aagcggcugcagccggggacacugc

SEQ ID NO: 7152 - RNA, 25 nt, Homo sapiens
gcugcagccggggacacugcgggcg

SEQ ID NO: 7153 - RNA, 25 nt, Homo sapiens
gggacacugcgggcgcggcagcugc

SEQ ID NO: 7154 - RNA, 25 nt, Homo sapiens
cuggagcugcugcacugcgcccacg

SEQ ID NO: 7155 - RNA, 25 nt, Homo sapiens
cugcugcacugcgcccacgaggccg

SEQ ID NO: 7156 - RNA, 25 nt, Homo sapiens
cugcacugcgcccacgaggccgagg

SEQ ID NO: 7157 - RNA, 25 nt, Homo sapiens
acugcgcccacgaggccgaggaggc

SEQ ID NO: 7158 - RNA, 25 nt, Homo sapiens
ccacgaggccgaggaggcuggaauu

SEQ ID NO: 7159 - RNA, 25 nt, Homo sapiens
gaggaggcuggaauuuggcagcacg

SEQ ID NO: 7160 - RNA, 25 nt, Homo sapiens
gcuggaauuuggcagcacgugguac

SEQ ID NO: 7161 - RNA, 25 nt, Homo sapiens
ggcagcacgugguacaggagcuccc

SEQ ID NO: 7162 - RNA, 25 nt, Homo sapiens
gagcuccccggccgccucucuuuuc

SEQ ID NO: 7163 - RNA, 25 nt, Homo sapiens
agcuccccggccgccucucuuuucu

SEQ ID NO: 7164 - RNA, 25 nt, Homo sapiens
cucacgccuccugaugcacauguac

SEQ ID NO: 7165 - RNA, 25 nt, Homo sapiens
ucacgccuccugaugcacauguacu

SEQ ID NO: 7166 - RNA, 25 nt, Homo sapiens
ccuccugaugcacauguacugggca

SEQ ID NO: 7167 - RNA, 25 nt, Homo sapiens
gaugcacauguacugggcaaggccu

SEQ ID NO: 7168 - RNA, 25 nt, Homo sapiens
gcacauguacugggcaaggccuugg

SEQ ID NO: 7169 - RNA, 25 nt, Homo sapiens
cauguacugggcaaggccuuggagg

SEQ ID NO: 7170 - RNA, 25 nt, Homo sapiens
guacugggcaaggccuuggaggcgg

SEQ ID NO: 7171 - RNA, 25 nt, Homo sapiens
uacugggcaaggccuuggaggcggc

SEQ ID NO: 7172 - RNA, 25 nt, Homo sapiens
gaggcggcgggccaagacuucuccc

SEQ ID NO: 7173 - RNA, 25 nt, Homo sapiens
acuucucccuggaccuccgcagcac

SEQ ID NO: 7174 - RNA, 25 nt, Homo sapiens
uccgcagcacuggcauuugccccuc

SEQ ID NO: 7175 - RNA, 25 nt, Homo sapiens
agcacuggcauuugccccucuggau

SEQ ID NO: 7176 - RNA, 25 nt, Homo sapiens
gcacuggcauuugccccucuggauu

SEQ ID NO: 7177 - RNA, 25 nt, Homo sapiens
cacuggcauuugccccucuggauug

SEQ ID NO: 7178 - RNA, 25 nt, Homo sapiens
ugccccucuggauuggggagccucg

SEQ ID NO: 7179 - RNA, 25 nt, Homo sapiens
gccccucuggauuggggagccucgu

SEQ ID NO: 7180 - RNA, 25 nt, Homo sapiens
gggacucagcugugucacccguuuc

SEQ ID NO: 7181 - RNA, 25 nt, Homo sapiens
acucagcugugucacccguuucagg

SEQ ID NO: 7182 - RNA, 25 nt, Homo sapiens
cucagcugugucacccguuucaggu

SEQ ID NO: 7183 - RNA, 25 nt, Homo sapiens
ucagcugugucacccguuucaggug

SEQ ID NO: 7184 - RNA, 25 nt, Homo sapiens
ugugucacccguuucagguggggug

SEQ ID NO: 7185 - RNA, 25 nt, Homo sapiens
gugucacccguuucaggugggguga

SEQ ID NO: 7186 - RNA, 25 nt, Homo sapiens
ugucacccguuucagguggggugag

SEQ ID NO: 7187 - RNA, 25 nt, Homo sapiens
cccguuucagguggggugaggggcu

SEQ ID NO: 7188 - RNA, 25 nt, Homo sapiens
ccguuucagguggggugaggggcuu

SEQ ID NO: 7189 - RNA, 25 nt, Homo sapiens
cguuucagguggggugaggggcuug

SEQ ID NO: 7190 - RNA, 25 nt, Homo sapiens
gcuccaccggcucugcaaaggccag

SEQ ID NO: 7191 - RNA, 25 nt, Homo sapiens
ugcuccaccggcucugcaaaggcca

SEQ ID NO: 7192 - RNA, 25 nt, Homo sapiens
cugcuccaccggcucugcaaaggcc

SEQ ID NO: 7193 - RNA, 25 nt, Homo sapiens
uagaacugcuccaccggcucugcaa

SEQ ID NO: 7194 - RNA, 25 nt, Homo sapiens
gcagugagcgguagaacugcuccac

SEQ ID NO: 7195 - RNA, 25 nt, Homo sapiens
ggcaccauacguguccugcagugag

SEQ ID NO: 7196 - RNA, 25 nt, Homo sapiens
aggaugccauccgggccugcgggcu

SEQ ID NO: 7197 - RNA, 25 nt, Homo sapiens
ggucuaggaugccauccgggccugc

SEQ ID NO: 7198 - RNA, 25 nt, Homo sapiens
aggucuaggaugccauccgggccug

SEQ ID NO: 7199 - RNA, 25 nt, Homo sapiens
uagguggaggucuaggaugccaucc

SEQ ID NO: 7200 - RNA, 25 nt, Homo sapiens
cuagguggaggucuaggaugccauc

SEQ ID NO: 7201 - RNA, 25 nt, Homo sapiens
ccggacguggucuagguggaggucu

SEQ ID NO: 7202 - RNA, 25 nt, Homo sapiens
agcugccguucugcccaguccgggg

SEQ ID NO: 7203 - RNA, 25 nt, Homo sapiens
gccagcugccguucugcccaguccg

SEQ ID NO: 7204 - RNA, 25 nt, Homo sapiens
ggccagcugccguucugcccagucc

SEQ ID NO: 7205 - RNA, 25 nt, Homo sapiens
gggccagcugccguucugcccaguc

SEQ ID NO: 7206 - RNA, 25 nt, Homo sapiens
aacagcaccucagccaggccuccuu

SEQ ID NO: 7207 - RNA, 25 nt, Homo sapiens
caacagcaccucagccaggccuccu

SEQ ID NO: 7208 - RNA, 25 nt, Homo sapiens
cuuggcagccaacagcaccucagcc

SEQ ID NO: 7209 - RNA, 25 nt, Homo sapiens
gucucacgcggccgccggugcuccu

SEQ ID NO: 7210 - RNA, 25 nt, Homo sapiens
aaucacucgugucucacgcggccgc

SEQ ID NO: 7211 - RNA, 25 nt, Homo sapiens
gcacagcaaucacucgugucucacg

SEQ ID NO: 7212 - RNA, 25 nt, Homo sapiens
gggaagccggccacaagcccaggcc

SEQ ID NO: 7213 - RNA, 25 nt, Homo sapiens
uacuggggaagccggccacaagccc

SEQ ID NO: 7214 - RNA, 25 nt, Homo sapiens
gaagacaaagucguacuggggaagc

SEQ ID NO: 7215 - RNA, 25 nt, Homo sapiens
ggacagagaagacaaagucguacug

SEQ ID NO: 7216 - RNA, 25 nt, Homo sapiens
gggacagagaagacaaagucguacu

SEQ ID NO: 7217 - RNA, 25 nt, Homo sapiens
ggggacagagaagacaaagucguac

SEQ ID NO: 7218 - RNA, 25 nt, Homo sapiens
ccccggacgguucaagcaauggcag

SEQ ID NO: 7219 - RNA, 25 nt, Homo sapiens
cccccggacgguucaagcaauggca

SEQ ID NO: 7220 - RNA, 25 nt, Homo sapiens
ucccccggacgguucaagcaauggc

SEQ ID NO: 7221 - RNA, 25 nt, Homo sapiens
ggcaucccccggacgguucaagcaa

SEQ ID NO: 7222 - RNA, 25 nt, Homo sapiens
cugcaggccauaggcaucccccgga

SEQ ID NO: 7223 - RNA, 25 nt, Homo sapiens
gauccugcaggccauaggcaucccc

SEQ ID NO: 7224 - RNA, 25 nt, Homo sapiens
gagaagagcagauccugcaggccau

SEQ ID NO: 7225 - RNA, 25 nt, Homo sapiens
gcccagggagaagagcagauccugc

SEQ ID NO: 7226 - RNA, 25 nt, Homo sapiens
gccgccacgaguggcugugggccca

SEQ ID NO: 7227 - RNA, 25 nt, Homo sapiens
ggccgccacgaguggcugugggccc

SEQ ID NO: 7228 - RNA, 25 nt, Homo sapiens
cucaucggccgccacgaguggcugu

SEQ ID NO: 7229 - RNA, 25 nt, Homo sapiens
ccucaucggccgccacgaguggcug

SEQ ID NO: 7230 - RNA, 25 nt, Homo sapiens
ugaaaaccucaucggccgccacgag

SEQ ID NO: 7231 - RNA, 25 nt, Homo sapiens
uucaagauguggcugaaaaccucau

SEQ ID NO: 7232 - RNA, 25 nt, Homo sapiens
aacgcggucaggucucuucaagaug

SEQ ID NO: 7233 - RNA, 25 nt, Homo sapiens
cgucuaggaugagcagaacgcgguc

SEQ ID NO: 7234 - RNA, 25 nt, Homo sapiens
gaagccgucuaggaugagcagaacg

SEQ ID NO: 7235 - RNA, 25 nt, Homo sapiens
cgcuuccagcuccucgaagccgucu

SEQ ID NO: 7236 - RNA, 25 nt, Homo sapiens
cggugccgguccgcacgugcugugc

SEQ ID NO: 7237 - RNA, 25 nt, Homo sapiens
ggagggagcagggcuccgccggugc

SEQ ID NO: 7238 - RNA, 25 nt, Homo sapiens
gcccccggagggagcagggcuccgc

SEQ ID NO: 7239 - RNA, 25 nt, Homo sapiens
cggccagcagcccccggagggagca

SEQ ID NO: 7240 - RNA, 25 nt, Homo sapiens
ccggccagcagcccccggagggagc

SEQ ID NO: 7241 - RNA, 25 nt, Homo sapiens
aaaaggccggccagcagcccccgga

SEQ ID NO: 7242 - RNA, 25 nt, Homo sapiens
gaaaaggccggccagcagcccccgg

SEQ ID NO: 7243 - RNA, 25 nt, Homo sapiens
cuggaaaaggccggccagcagcccc

SEQ ID NO: 7244 - RNA, 25 nt, Homo sapiens
cggagcagcuucuucuggaaaaggc

SEQ ID NO: 7245 - RNA, 25 nt, Homo sapiens
accucggagcagcuucuucuggaaa

SEQ ID NO: 7246 - RNA, 25 nt, Homo sapiens
ggugcaaccucggagcagcuucuuc

SEQ ID NO: 7247 - RNA, 25 nt, Homo sapiens
ggcugugaggaggagggugcaaccu

SEQ ID NO: 7248 - RNA, 25 nt, Homo sapiens
ccccggggccgggcugugaggagga

SEQ ID NO: 7249 - RNA, 25 nt, Homo sapiens
gccccggggccgggcugugaggagg

SEQ ID NO: 7250 - RNA, 25 nt, Homo sapiens
gcggccccggggccgggcugugagg

SEQ ID NO: 7251 - RNA, 25 nt, Homo sapiens
caggcggccccggggccgggcugug

SEQ ID NO: 7252 - RNA, 25 nt, Homo sapiens
cucuggaccaggcggccccggggcc

SEQ ID NO: 7253 - RNA, 25 nt, Homo sapiens
gcucuggaccaggcggccccggggc

SEQ ID NO: 7254 - RNA, 25 nt, Homo sapiens
ucaggcucuggaccaggcggccccg

SEQ ID NO: 7255 - RNA, 25 nt, Homo sapiens
cucaggcucuggaccaggcggcccc

SEQ ID NO: 7256 - RNA, 25 nt, Homo sapiens
gcucaggcucuggaccaggcggccc

SEQ ID NO: 7257 - RNA, 25 nt, Homo sapiens
ggccuugcucaggcucuggaccagg

SEQ ID NO: 7258 - RNA, 25 nt, Homo sapiens
gucggccuugcucaggcucuggacc

SEQ ID NO: 7259 - RNA, 25 nt, Homo sapiens
uagggcgucggccuugcucaggcuc

SEQ ID NO: 7260 - RNA, 25 nt, Homo sapiens
cucaaauagggcgucggccuugcuc

SEQ ID NO: 7261 - RNA, 25 nt, Homo sapiens
aagccggacagcucaaauagggcgu

SEQ ID NO: 7262 - RNA, 25 nt, Homo sapiens
auggagaagccggacagcucaaaua

SEQ ID NO: 7263 - RNA, 25 nt, Homo sapiens
cauggagaagccggacagcucaaau

SEQ ID NO: 7264 - RNA, 25 nt, Homo sapiens
gccugggccugcuccauggagaagc

SEQ ID NO: 7265 - RNA, 25 nt, Homo sapiens
aucacguaugccugggccugcucca

SEQ ID NO: 7266 - RNA, 25 nt, Homo sapiens
ucaaaguagcgcaucacguaugccu

SEQ ID NO: 7267 - RNA, 25 nt, Homo sapiens
cucaaaguagcgcaucacguaugcc

SEQ ID NO: 7268 - RNA, 25 nt, Homo sapiens
ccggaggagcgucagggcucugucu

SEQ ID NO: 7269 - RNA, 25 nt, Homo sapiens
aguggccggucccggaggagcguca

SEQ ID NO: 7270 - RNA, 25 nt, Homo sapiens
aaguggccggucccggaggagcguc

SEQ ID NO: 7271 - RNA, 25 nt, Homo sapiens
acugagaagaaguggccggucccgg

SEQ ID NO: 7272 - RNA, 25 nt, Homo sapiens
gugacugagaagaaguggccggucc

SEQ ID NO: 7273 - RNA, 25 nt, Homo sapiens
guggcugugacugagaagaaguggc

SEQ ID NO: 7274 - RNA, 25 nt, Homo sapiens
ggcuguggcugugacugagaagaag

SEQ ID NO: 7275 - RNA, 25 nt, Homo sapiens
cacugcccggcacaaaguagggcug

SEQ ID NO: 7276 - RNA, 25 nt, Homo sapiens
cuggcacacugcccggcacaaagua

SEQ ID NO: 7277 - RNA, 25 nt, Homo sapiens
gcuggcacacugcccggcacaaagu

SEQ ID NO: 7278 - RNA, 25 nt, Homo sapiens
ggccucugagagcuggcacacugcc

SEQ ID NO: 7279 - RNA, 25 nt, Homo sapiens
aagcuccagcagggccucugagagc

SEQ ID NO: 7280 - RNA, 25 nt, Homo sapiens
uuggcguccuccccaagcuccagca

SEQ ID NO: 7281 - RNA, 25 nt, Homo sapiens
cuuggcguccuccccaagcuccagc

SEQ ID NO: 7282 - RNA, 25 nt, Homo sapiens
agucccgugagcguggagggcagcu

SEQ ID NO: 7283 - RNA, 25 nt, Homo sapiens
cgacauagagucccgugagcgugga

SEQ ID NO: 7284 - RNA, 25 nt, Homo sapiens
ccgacauagagucccgugagcgugg

SEQ ID NO: 7285 - RNA, 25 nt, Homo sapiens
aggccgacauagagucccgugagcg

SEQ ID NO: 7286 - RNA, 25 nt, Homo sapiens
gcugucgagggcugcacggcccagc

SEQ ID NO: 7287 - RNA, 25 nt, Homo sapiens
cccgggggggcugucgagggcugca

SEQ ID NO: 7288 - RNA, 25 nt, Homo sapiens
gccagggccccgggggggcugucga

SEQ ID NO: 7289 - RNA, 25 nt, Homo sapiens
ugccagggccccgggggggcugucg

SEQ ID NO: 7290 - RNA, 25 nt, Homo sapiens
ggccagcucugccagggccccgggg

SEQ ID NO: 7291 - RNA, 25 nt, Homo sapiens
uggccagcucugccagggccccggg

SEQ ID NO: 7292 - RNA, 25 nt, Homo sapiens
uuggccagcucugccagggccccgg

SEQ ID NO: 7293 - RNA, 25 nt, Homo sapiens
cuuggccagcucugccagggccccg

SEQ ID NO: 7294 - RNA, 25 nt, Homo sapiens
gcuuggccagcucugccagggcccc

SEQ ID NO: 7295 - RNA, 25 nt, Homo sapiens
agcuuggccagcucugccagggccc

SEQ ID NO: 7296 - RNA, 25 nt, Homo sapiens
caggccagcuuggccagcucugcca

SEQ ID NO: 7297 - RNA, 25 nt, Homo sapiens
ccaggccagcuuggccagcucugcc

SEQ ID NO: 7298 - RNA, 25 nt, Homo sapiens
cugcggcccagcucccaggccagcu

SEQ ID NO: 7299 - RNA, 25 nt, Homo sapiens
cuuugaugucugcggcccagcuccc

SEQ ID NO: 7300 - RNA, 25 nt, Homo sapiens
cuccuguaggguacuuugaugucug

SEQ ID NO: 7301 - RNA, 25 nt, Homo sapiens
gcggaugggaacugguccuccugua

SEQ ID NO: 7302 - RNA, 25 nt, Homo sapiens
ugcggaugggaacugguccuccugu

SEQ ID NO: 7303 - RNA, 25 nt, Homo sapiens
gguccucacgucugcggaugggaac

SEQ ID NO: 7304 - RNA, 25 nt, Homo sapiens
cgcccagguccucacgucugcggau

SEQ ID NO: 7305 - RNA, 25 nt, Homo sapiens
ucgcccagguccucacgucugcgga

SEQ ID NO: 7306 - RNA, 25 nt, Homo sapiens
gccaucgcccagguccucacgucug

SEQ ID NO: 7307 - RNA, 25 nt, Homo sapiens
uggacuaagccuuuggccaucgccc

SEQ ID NO: 7308 - RNA, 25 nt, Homo sapiens
cgcgguggguguuggacuaagccuu

SEQ ID NO: 7309 - RNA, 25 nt, Homo sapiens
ggacucugcggcccgcggugggugu

SEQ ID NO: 7310 - RNA, 25 nt, Homo sapiens
cagcucggacucugcggcccgcggu

SEQ ID NO: 7311 - RNA, 25 nt, Homo sapiens
ccagcucggacucugcggcccgcgg

SEQ ID NO: 7312 - RNA, 25 nt, Homo sapiens
aggccagcucggacucugcggcccg

SEQ ID NO: 7313 - RNA, 25 nt, Homo sapiens
cuggggaaggccagcucggacucug

SEQ ID NO: 7314 - RNA, 25 nt, Homo sapiens
aggaggaagcuggggaaggccagcu

SEQ ID NO: 7315 - RNA, 25 nt, Homo sapiens
aagcauugcaggaggaagcugggga

SEQ ID NO: 7316 - RNA, 25 nt, Homo sapiens
caggaagcauugcaggaggaagcug

SEQ ID NO: 7317 - RNA, 25 nt, Homo sapiens
ccaggaagcauugcaggaggaagcu

SEQ ID NO: 7318 - RNA, 25 nt, Homo sapiens
cccaggaagcauugcaggaggaagc

SEQ ID NO: 7319 - RNA, 25 nt, Homo sapiens
cagggcccccaggaagcauugcagg

SEQ ID NO: 7320 - RNA, 25 nt, Homo sapiens
ccacagggcccccaggaagcauugc

SEQ ID NO: 7321 - RNA, 25 nt, Homo sapiens
acucagagccagccacagggccccc

SEQ ID NO: 7322 - RNA, 25 nt, Homo sapiens
auuucgccacucagagccagccaca

SEQ ID NO: 7323 - RNA, 25 nt, Homo sapiens
gauuucgccacucagagccagccac

SEQ ID NO: 7324 - RNA, 25 nt, Homo sapiens
ccuuggggucaaugcuagguacugc

SEQ ID NO: 7325 - RNA, 25 nt, Homo sapiens
uccuuggggucaaugcuagguacug

SEQ ID NO: 7326 - RNA, 25 nt, Homo sapiens
ccucuucuuccuuggggucaaugcu

SEQ ID NO: 7327 - RNA, 25 nt, Homo sapiens
uugucauagggccucuucuuccuug

SEQ ID NO: 7328 - RNA, 25 nt, Homo sapiens
guugucauagggccucuucuuccuu

SEQ ID NO: 7329 - RNA, 25 nt, Homo sapiens
aguugucauagggccucuucuuccu

SEQ ID NO: 7330 - RNA, 25 nt, Homo sapiens
gcacgcccuccagccaguugucaua

SEQ ID NO: 7331 - RNA, 25 nt, Homo sapiens
ggcacgcccuccagccaguugucau

SEQ ID NO: 7332 - RNA, 25 nt, Homo sapiens
ggaagaucagcccagccagaaagcg

SEQ ID NO: 7333 - RNA, 25 nt, Homo sapiens
ggcucccaggcagcgggcgggaggc

SEQ ID NO: 7334 - RNA, 25 nt, Homo sapiens
guagggcucccaggcagcgggcggg

SEQ ID NO: 7335 - RNA, 25 nt, Homo sapiens
cgaguagggcucccaggcagcgggc

SEQ ID NO: 7336 - RNA, 25 nt, Homo sapiens
ccgaguagggcucccaggcagcggg

SEQ ID NO: 7337 - RNA, 25 nt, Homo sapiens
ggcccgaguagggcucccaggcagc

SEQ ID NO: 7338 - RNA, 25 nt, Homo sapiens
uggcccgaguagggcucccaggcag

SEQ ID NO: 7339 - RNA, 25 nt, Homo sapiens
cgccgauggcccgaguagggcuccc

SEQ ID NO: 7340 - RNA, 25 nt, Homo sapiens
gaggcagccgccgauggcccgagua

SEQ ID NO: 7341 - RNA, 25 nt, Homo sapiens
cgaggcagccgccgauggcccgagu

SEQ ID NO: 7342 - RNA, 25 nt, Homo sapiens
uccuguccaccgaggcagccgccga

SEQ ID NO: 7343 - RNA, 25 nt, Homo sapiens
agcaccuucugcuuccuguccaccg

SEQ ID NO: 7344 - RNA, 25 nt, Homo sapiens
caguguccccggcugcagccgcuuc

SEQ ID NO: 7345 - RNA, 25 nt, Homo sapiens
gcagcugccgcgcccgcaguguccc

SEQ ID NO: 7346 - RNA, 25 nt, Homo sapiens
caaauuccagccuccucggccucgu

SEQ ID NO: 7347 - RNA, 25 nt, Homo sapiens
ccaaauuccagccuccucggccucg

SEQ ID NO: 7348 - RNA, 25 nt, Homo sapiens
acgugcugccaaauuccagccuccu

SEQ ID NO: 7349 - RNA, 25 nt, Homo sapiens
ggugcccagaaaagagaggcggccg

SEQ ID NO: 7350 - RNA, 25 nt, Homo sapiens
gggugcccagaaaagagaggcggcc

SEQ ID NO: 7351 - RNA, 25 nt, Homo sapiens
cgggugcccagaaaagagaggcggc

SEQ ID NO: 7352 - RNA, 25 nt, Homo sapiens
gaggcgggugcccagaaaagagagg

SEQ ID NO: 7353 - RNA, 25 nt, Homo sapiens
cgugaggcgggugcccagaaaagag

SEQ ID NO: 7354 - RNA, 25 nt, Homo sapiens
acaugugcaucaggaggcgugaggc

SEQ ID NO: 7355 - RNA, 25 nt, Homo sapiens
uacaugugcaucaggaggcgugagg

SEQ ID NO: 7356 - RNA, 25 nt, Homo sapiens
caguacaugugcaucaggaggcgug

SEQ ID NO: 7357 - RNA, 25 nt, Homo sapiens
ccuugcccaguacaugugcaucagg

SEQ ID NO: 7358 - RNA, 25 nt, Homo sapiens
aggccuugcccaguacaugugcauc

SEQ ID NO: 7359 - RNA, 25 nt, Homo sapiens
gagaagucuuggcccgccgccucca

SEQ ID NO: 7360 - RNA, 25 nt, Homo sapiens
gcugcggagguccagggagaagucu

SEQ ID NO: 7361 - RNA, 25 nt, Homo sapiens
caaaugccagugcugcggaggucca

SEQ ID NO: 7362 - RNA, 25 nt, Homo sapiens
gcaaaugccagugcugcggaggucc

SEQ ID NO: 7363 - RNA, 25 nt, Homo sapiens
agaggggcaaaugccagugcugcgg

SEQ ID NO: 7364 - RNA, 25 nt, Homo sapiens
uccagaggggcaaaugccagugcug

SEQ ID NO: 7365 - RNA, 25 nt, Homo sapiens
ucccacgaggcuccccaauccagag

SEQ ID NO: 7366 - RNA, 25 nt, Homo sapiens
gucccacgaggcuccccaauccaga

SEQ ID NO: 7367 - RNA, 25 nt, Homo sapiens
agucccacgaggcuccccaauccag

SEQ ID NO: 7368 - RNA, 25 nt, Homo sapiens
acgggugacacagcugagucccacg

SEQ ID NO: 7369 - RNA, 25 nt, Homo sapiens
ccaagccccucaccccaccugaaac

SEQ ID NO: 7370 - RNA, 25 nt, Homo sapiens
cccaagccccucaccccaccugaaa

SEQ ID NO: 7371 - RNA, 25 nt, Homo sapiens
gcugcccuuccauuaaggucuagcc

SEQ ID NO: 7372 - RNA, 25 nt, Homo sapiens
uaaggucuagccuggucaccgugcc

SEQ ID NO: 7373 - RNA, 25 nt, Homo sapiens
aaggucuagccuggucaccgugccu

SEQ ID NO: 7374 - RNA, 25 nt, Homo sapiens
agccuggucaccgugccugggucug

SEQ ID NO: 7375 - RNA, 25 nt, Homo sapiens
ccugggucugaggcccucccuccac

SEQ ID NO: 7376 - RNA, 25 nt, Homo sapiens
cugggucugaggcccucccuccaca

SEQ ID NO: 7377 - RNA, 25 nt, Homo sapiens
cuccacagggcugccuugagcgaca

SEQ ID NO: 7378 - RNA, 25 nt, Homo sapiens
cacagggcugccuugagcgacacgg

SEQ ID NO: 7379 - RNA, 25 nt, Homo sapiens
ugccuugagcgacacgguggcgcug

SEQ ID NO: 7380 - RNA, 25 nt, Homo sapiens
gccuugagcgacacgguggcgcugu

SEQ ID NO: 7381 - RNA, 25 nt, Homo sapiens
cgcugugggagucccugcagcagca

SEQ ID NO: 7382 - RNA, 25 nt, Homo sapiens
gcugugggagucccugcagcagcau

SEQ ID NO: 7383 - RNA, 25 nt, Homo sapiens
cugugggagucccugcagcagcaug

SEQ ID NO: 7384 - RNA, 25 nt, Homo sapiens
cagcauggggagaccaagcuacuuc

SEQ ID NO: 7385 - RNA, 25 nt, Homo sapiens
gagaccaagcuacuucaggcagcag

SEQ ID NO: 7386 - RNA, 25 nt, Homo sapiens
gagccuuucaaagccaagucccuga

SEQ ID NO: 7387 - RNA, 25 nt, Homo sapiens
uucaaagccaagucccugaaggaug

SEQ ID NO: 7388 - RNA, 25 nt, Homo sapiens
aagucccugaaggauguggaagacc

SEQ ID NO: 7389 - RNA, 25 nt, Homo sapiens
agucccugaaggauguggaagaccu

SEQ ID NO: 7390 - RNA, 25 nt, Homo sapiens
ccugggaaagcuugugcagacucag

SEQ ID NO: 7391 - RNA, 25 nt, Homo sapiens
aagcuugugcagacucagaggugag

SEQ ID NO: 7392 - RNA, 25 nt, Homo sapiens
ugugcagacucagaggugagaggag

SEQ ID NO: 7393 - RNA, 25 nt, Homo sapiens
gcagacucagaggugagaggagagg

SEQ ID NO: 7394 - RNA, 25 nt, Homo sapiens
acucagaggugagaggagaggcgga

SEQ ID NO: 7395 - RNA, 25 nt, Homo sapiens
gugaccaggcuagaccuuaauggaa

SEQ ID NO: 7396 - RNA, 25 nt, Homo sapiens
ggugaccaggcuagaccuuaaugga

SEQ ID NO: 7397 - RNA, 25 nt, Homo sapiens
gcacggugaccaggcuagaccuuaa

SEQ ID NO: 7398 - RNA, 25 nt, Homo sapiens
ggccucagacccaggcacggugacc

SEQ ID NO: 7399 - RNA, 25 nt, Homo sapiens
ggagggagggccucagacccaggca

SEQ ID NO: 7400 - RNA, 25 nt, Homo sapiens
ccuguggagggagggccucagaccc

SEQ ID NO: 7401 - RNA, 25 nt, Homo sapiens
cgcucaaggcagcccuguggaggga

SEQ ID NO: 7402 - RNA, 25 nt, Homo sapiens
ucgcucaaggcagcccuguggaggg

SEQ ID NO: 7403 - RNA, 25 nt, Homo sapiens
gugucgcucaaggcagcccugugga

SEQ ID NO: 7404 - RNA, 25 nt, Homo sapiens
cgugucgcucaaggcagcccugugg

SEQ ID NO: 7405 - RNA, 25 nt, Homo sapiens
caccgugucgcucaaggcagcccug

SEQ ID NO: 7406 - RNA, 25 nt, Homo sapiens
ucccacagcgccaccgugucgcuca

SEQ ID NO: 7407 - RNA, 25 nt, Homo sapiens
agcuuggucuccccaugcugcugca

SEQ ID NO: 7408 - RNA, 25 nt, Homo sapiens
uagcuuggucuccccaugcugcugc

SEQ ID NO: 7409 - RNA, 25 nt, Homo sapiens
uucuccucugcugccugaaguagcu

SEQ ID NO: 7410 - RNA, 25 nt, Homo sapiens
agggacuuggcuuugaaaggcucga

SEQ ID NO: 7411 - RNA, 25 nt, Homo sapiens
cauccuucagggacuuggcuuugaa

SEQ ID NO: 7412 - RNA, 25 nt, Homo sapiens
aggucuuccacauccuucagggacu

SEQ ID NO: 7413 - RNA, 25 nt, Homo sapiens
uuucccaggucuuccacauccuuca

SEQ ID NO: 7414 - RNA, 25 nt, Homo sapiens
cuuucccaggucuuccacauccuuc

SEQ ID NO: 7415 - RNA, 25 nt, Homo sapiens
ccucugagucugcacaagcuuuccc

SEQ ID NO: 7416 - RNA, 25 nt, Homo sapiens
guucucuccaggacgagaaguuccu

SEQ ID NO: 7417 - RNA, 25 nt, Homo sapiens
cgagaaguuccucggaagacacagc

SEQ ID NO: 7418 - RNA, 25 nt, Homo sapiens
gagaaguuccucggaagacacagcu

SEQ ID NO: 7419 - RNA, 25 nt, Homo sapiens
agaaguuccucggaagacacagcug

SEQ ID NO: 7420 - RNA, 25 nt, Homo sapiens
cacagcuggggagcucccugcuguu

SEQ ID NO: 7421 - RNA, 25 nt, Homo sapiens
acagcuggggagcucccugcuguuc

SEQ ID NO: 7422 - RNA, 25 nt, Homo sapiens
ccugcuguucgggaccuaaagaaac

SEQ ID NO: 7423 - RNA, 25 nt, Homo sapiens
aagaaacuggaguuugcguaagcaa

SEQ ID NO: 7424 - RNA, 25 nt, Homo sapiens
agaaacuggaguuugcguaagcaaa

SEQ ID NO: 7425 - RNA, 25 nt, Homo sapiens
gaaacuggaguuugcguaagcaaag

SEQ ID NO: 7426 - RNA, 25 nt, Homo sapiens
acuggaguuugcguaagcaaagggg

SEQ ID NO: 7427 - RNA, 25 nt, Homo sapiens
aggaacuucucguccuggagagaac

SEQ ID NO: 7428 - RNA, 25 nt, Homo sapiens
gugucuuccgaggaacuucucgucc

SEQ ID NO: 7429 - RNA, 25 nt, Homo sapiens
gggagcuccccagcugugucuuccg

SEQ ID NO: 7430 - RNA, 25 nt, Homo sapiens
caguuucuuuaggucccgaacagca

SEQ ID NO: 7431 - RNA, 25 nt, Homo sapiens
ccaguuucuuuaggucccgaacagc

SEQ ID NO: 7432 - RNA, 25 nt, Homo sapiens
ugcuuacgcaaacuccaguuucuuu

SEQ ID NO: 7433 - RNA, 25 nt, Homo sapiens
ugccuccuaggcugggcccugucuc

SEQ ID NO: 7434 - RNA, 25 nt, Homo sapiens
aggcugggcccugucucaggccccc

SEQ ID NO: 7435 - RNA, 25 nt, Homo sapiens
ucaggcccccaggcuuuccccaaac

SEQ ID NO: 7436 - RNA, 25 nt, Homo sapiens
cccccaggcuuuccccaaacuggug

SEQ ID NO: 7437 - RNA, 25 nt, Homo sapiens
uuccccaaacuggugcggauccuca

SEQ ID NO: 7438 - RNA, 25 nt, Homo sapiens
acggccuuuuccucccugcagcauc

SEQ ID NO: 7439 - RNA, 25 nt, Homo sapiens
cagcaucuggagugaguauagacuc

SEQ ID NO: 7440 - RNA, 25 nt, Homo sapiens
agcaucuggagugaguauagacucu

SEQ ID NO: 7441 - RNA, 25 nt, Homo sapiens
ggcccagccuaggaggcaaagagca

SEQ ID NO: 7442 - RNA, 25 nt, Homo sapiens
ggccugagacagggcccagccuagg

SEQ ID NO: 7443 - RNA, 25 nt, Homo sapiens
gggggccugagacagggcccagccu

SEQ ID NO: 7444 - RNA, 25 nt, Homo sapiens
ggggaaagccugggggccugagaca

SEQ ID NO: 7445 - RNA, 25 nt, Homo sapiens
uggggaaagccugggggccugagac

SEQ ID NO: 7446 - RNA, 25 nt, Homo sapiens
ccgcaccaguuuggggaaagccugg

SEQ ID NO: 7447 - RNA, 25 nt, Homo sapiens
uccgcaccaguuuggggaaagccug

SEQ ID NO: 7448 - RNA, 25 nt, Homo sapiens
auccgcaccaguuuggggaaagccu

SEQ ID NO: 7449 - RNA, 25 nt, Homo sapiens
gauccgcaccaguuuggggaaagcc

SEQ ID NO: 7450 - RNA, 25 nt, Homo sapiens
ggccgugaggauccgcaccaguuug

SEQ ID NO: 7451 - RNA, 25 nt, Homo sapiens
aggccgugaggauccgcaccaguuu

SEQ ID NO: 7452 - RNA, 25 nt, Homo sapiens
aaggccgugaggauccgcaccaguu

SEQ ID NO: 7453 - RNA, 25 nt, Homo sapiens
augcugcagggaggaaaaggccgug

SEQ ID NO: 7454 - RNA, 25 nt, Homo sapiens
cacuccagaugcugcagggaggaaa

SEQ ID NO: 7455 - RNA, 25 nt, Homo sapiens
uauacucacuccagaugcugcaggg

SEQ ID NO: 7456 - RNA, 25 nt, Homo sapiens
gucuauacucacuccagaugcugca

SEQ ID NO: 7457 - RNA, 25 nt, Homo sapiens
agucuauacucacuccagaugcugc

SEQ ID NO: 7458 - RNA, 25 nt, Homo sapiens
uggaugcgcugagugagaacaagau

SEQ ID NO: 7459 - RNA, 25 nt, Homo sapiens
ggaugcgcugagugagaacaagauc

SEQ ID NO: 7460 - RNA, 25 nt, Homo sapiens
gaugcgcugagugagaacaagaucg

SEQ ID NO: 7461 - RNA, 25 nt, Homo sapiens
cugagugagaacaagaucggggacg

SEQ ID NO: 7462 - RNA, 25 nt, Homo sapiens
ugagugagaacaagaucggggacga

SEQ ID NO: 7463 - RNA, 25 nt, Homo sapiens
gccaccuucccccagcugaaguccu

SEQ ID NO: 7464 - RNA, 25 nt, Homo sapiens
cuuggaaacccucaagugagugagc

SEQ ID NO: 7465 - RNA, 25 nt, Homo sapiens
uuggaaacccucaagugagugagcu

SEQ ID NO: 7466 - RNA, 25 nt, Homo sapiens
cauccaggcugcagguggaaucaga

SEQ ID NO: 7467 - RNA, 25 nt, Homo sapiens
ucacucagcgcauccaggcugcagg

SEQ ID NO: 7468 - RNA, 25 nt, Homo sapiens
uucucacucagcgcauccaggcugc

SEQ ID NO: 7469 - RNA, 25 nt, Homo sapiens
gaucuuguucucacucagcgcaucc

SEQ ID NO: 7470 - RNA, 25 nt, Homo sapiens
uccaaggacuucagcugggggaagg

SEQ ID NO: 7471 - RNA, 25 nt, Homo sapiens
guuuccaaggacuucagcuggggga

SEQ ID NO: 7472 - RNA, 25 nt, Homo sapiens
gaggguuuccaaggacuucagcugg

SEQ ID NO: 7473 - RNA, 25 nt, Homo sapiens
ugaggguuuccaaggacuucagcug

SEQ ID NO: 7474 - RNA, 25 nt, Homo sapiens
uugaggguuuccaaggacuucagcu

SEQ ID NO: 7475 - RNA, 25 nt, Homo sapiens
cuugaggguuuccaaggacuucagc

SEQ ID NO: 7476 - RNA, 25 nt, Homo sapiens
cagcucacucacuugaggguuucca

SEQ ID NO: 7477 - RNA, 25 nt, Homo sapiens
cugucccagaacaacaucacugacc

SEQ ID NO: 7478 - RNA, 25 nt, Homo sapiens
ugucccagaacaacaucacugaccu

SEQ ID NO: 7479 - RNA, 25 nt, Homo sapiens
gaccugggugccuacaaacucgccg

SEQ ID NO: 7480 - RNA, 25 nt, Homo sapiens
gccuucgcucgcugcaucccugcuc

SEQ ID NO: 7481 - RNA, 25 nt, Homo sapiens
gcucgcugcaucccugcucaggcua

SEQ ID NO: 7482 - RNA, 25 nt, Homo sapiens
gcaucccugcucaggcuaaggugag

SEQ ID NO: 7483 - RNA, 25 nt, Homo sapiens
caucccugcucaggcuaaggugagu

SEQ ID NO: 7484 - RNA, 25 nt, Homo sapiens
aucccugcucaggcuaaggugagug

SEQ ID NO: 7485 - RNA, 25 nt, Homo sapiens
gcucaggcuaaggugaguggggccc

SEQ ID NO: 7486 - RNA, 25 nt, Homo sapiens
gggacagacugcggggacacaguga

SEQ ID NO: 7487 - RNA, 25 nt, Homo sapiens
ugggacagacugcggggacacagug

SEQ ID NO: 7488 - RNA, 25 nt, Homo sapiens
ugauguuguucugggacagacugcg

SEQ ID NO: 7489 - RNA, 25 nt, Homo sapiens
gugauguuguucugggacagacugc

SEQ ID NO: 7490 - RNA, 25 nt, Homo sapiens
agugauguuguucugggacagacug

SEQ ID NO: 7491 - RNA, 25 nt, Homo sapiens
gcacccaggucagugauguuguucu

SEQ ID NO: 7492 - RNA, 25 nt, Homo sapiens
ggcacccaggucagugauguuguuc

SEQ ID NO: 7493 - RNA, 25 nt, Homo sapiens
ggccucggcgaguuuguaggcaccc

SEQ ID NO: 7494 - RNA, 25 nt, Homo sapiens
gaaggcagggccucggcgaguuugu

SEQ ID NO: 7495 - RNA, 25 nt, Homo sapiens
gaugcagcgagcgaaggcagggccu

SEQ ID NO: 7496 - RNA, 25 nt, Homo sapiens
agcagggaugcagcgagcgaaggca

SEQ ID NO: 7497 - RNA, 25 nt, Homo sapiens
gagcagggaugcagcgagcgaaggc

SEQ ID NO: 7498 - RNA, 25 nt, Homo sapiens
gccugagcagggaugcagcgagcga

SEQ ID NO: 7499 - RNA, 25 nt, Homo sapiens
ggccccacucaccuuagccugagca

SEQ ID NO: 7500 - RNA, 25 nt, Homo sapiens
gggccccacucaccuuagccugagc

SEQ ID NO: 7501 - RNA, 25 nt, Homo sapiens
uuguacaauaacugcaucugcgacg

SEQ ID NO: 7502 - RNA, 25 nt, Homo sapiens
uguacaauaacugcaucugcgacgu

SEQ ID NO: 7503 - RNA, 25 nt, Homo sapiens
aucugcgacgugggagccgagagcu

SEQ ID NO: 7504 - RNA, 25 nt, Homo sapiens
gccgagagcuuggcucgugugcuuc

SEQ ID NO: 7505 - RNA, 25 nt, Homo sapiens
agcuuggcucgugugcuuccggaca

SEQ ID NO: 7506 - RNA, 25 nt, Homo sapiens
ugugcuuccggacauggugucccuc

SEQ ID NO: 7507 - RNA, 25 nt, Homo sapiens
gugcuuccggacauggugucccucc

SEQ ID NO: 7508 - RNA, 25 nt, Homo sapiens
ccggacauggugucccuccggguga

SEQ ID NO: 7509 - RNA, 25 nt, Homo sapiens
gucccuccgggugauggagugagug

SEQ ID NO: 7510 - RNA, 25 nt, Homo sapiens
ucccuccgggugauggagugagugu

SEQ ID NO: 7511 - RNA, 25 nt, Homo sapiens
gggugauggagugagugugggaguc

SEQ ID NO: 7512 - RNA, 25 nt, Homo sapiens
ggugauggagugagugugggagucu

SEQ ID NO: 7513 - RNA, 25 nt, Homo sapiens
uuauuguacaagcugucggaaacag

SEQ ID NO: 7514 - RNA, 25 nt, Homo sapiens
cagaugcaguuauuguacaagcugu

SEQ ID NO: 7515 - RNA, 25 nt, Homo sapiens
uccggaagcacacgagccaagcucu

SEQ ID NO: 7516 - RNA, 25 nt, Homo sapiens
ccaucacccggagggacaccauguc

SEQ ID NO: 7517 - RNA, 25 nt, Homo sapiens
ucccacacucacuccaucacccgga

SEQ ID NO: 7518 - RNA, 25 nt, Homo sapiens
cucccacacucacuccaucacccgg

SEQ ID NO: 7519 - RNA, 25 nt, Homo sapiens
agacucccacacucacuccaucacc

SEQ ID NO: 7520 - RNA, 25 nt, Homo sapiens
gccagcguccaguacaacaaguuca

SEQ ID NO: 7521 - RNA, 25 nt, Homo sapiens
uccaguacaacaaguucacggcugc

SEQ ID NO: 7522 - RNA, 25 nt, Homo sapiens
ccaguacaacaaguucacggcugcc

SEQ ID NO: 7523 - RNA, 25 nt, Homo sapiens
caguacaacaaguucacggcugccg

SEQ ID NO: 7524 - RNA, 25 nt, Homo sapiens
ggcccagcagcucgcugccagccuu

SEQ ID NO: 7525 - RNA, 25 nt, Homo sapiens
ccagcagcucgcugccagccuucgg

SEQ ID NO: 7526 - RNA, 25 nt, Homo sapiens
gccagccuucggagguguccucaug

SEQ ID NO: 7527 - RNA, 25 nt, Homo sapiens
cggagguguccucauguggagacgc

SEQ ID NO: 7528 - RNA, 25 nt, Homo sapiens
cauguggagacgcuggcguaagucc

SEQ ID NO: 7529 - RNA, 25 nt, Homo sapiens
acgcuggcguaaguccaggcaaccc

SEQ ID NO: 7530 - RNA, 25 nt, Homo sapiens
gccgugaacuuguuguacuggacgc

SEQ ID NO: 7531 - RNA, 25 nt, Homo sapiens
cccggcagccgugaacuuguuguac

SEQ ID NO: 7532 - RNA, 25 nt, Homo sapiens
aggcuggcagcgagcugcugggccc

SEQ ID NO: 7533 - RNA, 25 nt, Homo sapiens
cuccgaaggcuggcagcgagcugcu

SEQ ID NO: 7534 - RNA, 25 nt, Homo sapiens
ccuccgaaggcuggcagcgagcugc

SEQ ID NO: 7535 - RNA, 25 nt, Homo sapiens
uccacaugaggacaccuccgaaggc

SEQ ID NO: 7536 - RNA, 25 nt, Homo sapiens
cgucuccacaugaggacaccuccga

SEQ ID NO: 7537 - RNA, 25 nt, Homo sapiens
ggacuuacgccagcgucuccacaug

SEQ ID NO: 7538 - RNA, 25 nt, Homo sapiens
acgcccaccaucccauucagugucc

SEQ ID NO: 7539 - RNA, 25 nt, Homo sapiens
aguguccaggaacaccugcaacaac

SEQ ID NO: 7540 - RNA, 25 nt, Homo sapiens
ggaacaccugcaacaacaggauuca

SEQ ID NO: 7541 - RNA, 25 nt, Homo sapiens
gccugagaugaucccagcugugcuc

SEQ ID NO: 7542 - RNA, 25 nt, Homo sapiens
agaugaucccagcugugcucuggac

SEQ ID NO: 7543 - RNA, 25 nt, Homo sapiens
gaugaucccagcugugcucuggaca

SEQ ID NO: 7544 - RNA, 25 nt, Homo sapiens
cagcugugcucuggacaggguaacc

SEQ ID NO: 7545 - RNA, 25 nt, Homo sapiens
agcugugcucuggacaggguaacca

SEQ ID NO: 7546 - RNA, 25 nt, Homo sapiens
ugugcucuggacaggguaaccaggg

SEQ ID NO: 7547 - RNA, 25 nt, Homo sapiens
gugcucuggacaggguaaccagggu

SEQ ID NO: 7548 - RNA, 25 nt, Homo sapiens
cuggacaggguaaccagggugggcu

SEQ ID NO: 7549 - RNA, 25 nt, Homo sapiens
uggacaggguaaccagggugggcuu

SEQ ID NO: 7550 - RNA, 25 nt, Homo sapiens
gcguccacauccugcaaggggggau

SEQ ID NO: 7551 - RNA, 25 nt, Homo sapiens
ggcguccacauccugcaagggggga

SEQ ID NO: 7552 - RNA, 25 nt, Homo sapiens
ggugggcguccacauccugcaaggg

SEQ ID NO: 7553 - RNA, 25 nt, Homo sapiens
uggugggcguccacauccugcaagg

SEQ ID NO: 7554 - RNA, 25 nt, Homo sapiens
auggugggcguccacauccugcaag

SEQ ID NO: 7555 - RNA, 25 nt, Homo sapiens
gauggugggcguccacauccugcaa

SEQ ID NO: 7556 - RNA, 25 nt, Homo sapiens
ggauggugggcguccacauccugca

SEQ ID NO: 7557 - RNA, 25 nt, Homo sapiens
guuccuggacacugaaugggauggu

SEQ ID NO: 7558 - RNA, 25 nt, Homo sapiens
uguuccuggacacugaaugggaugg

SEQ ID NO: 7559 - RNA, 25 nt, Homo sapiens
agguguuccuggacacugaauggga

SEQ ID NO: 7560 - RNA, 25 nt, Homo sapiens
uugcagguguuccuggacacugaau

SEQ ID NO: 7561 - RNA, 25 nt, Homo sapiens
guugcagguguuccuggacacugaa

SEQ ID NO: 7562 - RNA, 25 nt, Homo sapiens
ugaauccuguuguugcagguguucc

SEQ ID NO: 7563 - RNA, 25 nt, Homo sapiens
gcugauccgugaauccuguuguugc

SEQ ID NO: 7564 - RNA, 25 nt, Homo sapiens
uccagagcacagcugggaucaucuc

SEQ ID NO: 7565 - RNA, 25 nt, Homo sapiens
ugguuacccuguccagagcacagcu

SEQ ID NO: 7566 - RNA, 25 nt, Homo sapiens
cugguuacccuguccagagcacagc

SEQ ID NO: 7567 - RNA, 25 nt, Homo sapiens
uccucccgcuacagcauguucucug

SEQ ID NO: 7568 - RNA, 25 nt, Homo sapiens
uguucucugaggacacuaaccacgc

SEQ ID NO: 7569 - RNA, 25 nt, Homo sapiens
acacuaaccacgcuggaccuugaac

SEQ ID NO: 7570 - RNA, 25 nt, Homo sapiens
cacuaaccacgcuggaccuugaacu

SEQ ID NO: 7571 - RNA, 25 nt, Homo sapiens
cgcuggaccuugaacuggguacuug

SEQ ID NO: 7572 - RNA, 25 nt, Homo sapiens
guacuuguggacacagcucuucucc

SEQ ID NO: 7573 - RNA, 25 nt, Homo sapiens
cuguaucccaugagccucagcaucc

SEQ ID NO: 7574 - RNA, 25 nt, Homo sapiens
ccaugagccucagcauccuggcacc

SEQ ID NO: 7575 - RNA, 25 nt, Homo sapiens
cagcauccuggcacccggccccugc

SEQ ID NO: 7576 - RNA, 25 nt, Homo sapiens
ccuggcacccggccccugcugguuc

SEQ ID NO: 7577 - RNA, 25 nt, Homo sapiens
cuggcacccggccccugcugguuca

SEQ ID NO: 7578 - RNA, 25 nt, Homo sapiens
cacccggccccugcugguucagggu

SEQ ID NO: 7579 - RNA, 25 nt, Homo sapiens
ugcugguucaggguuggccccugcc

SEQ ID NO: 7580 - RNA, 25 nt, Homo sapiens
uucaggguuggccccugcccggcug

SEQ ID NO: 7581 - RNA, 25 nt, Homo sapiens
cacaucuugcucugcugacagacac

SEQ ID NO: 7582 - RNA, 25 nt, Homo sapiens
cuugcucugcugacagacacaggcc

SEQ ID NO: 7583 - RNA, 25 nt, Homo sapiens
ugcugacagacacaggcccggcucc

SEQ ID NO: 7584 - RNA, 25 nt, Homo sapiens
gcuccaggcuccuuuagcgcccagu

SEQ ID NO: 7585 - RNA, 25 nt, Homo sapiens
cuccaggcuccuuuagcgcccaguu

SEQ ID NO: 7586 - RNA, 25 nt, Homo sapiens
caggcuccuuuagcgcccaguuggg

SEQ ID NO: 7587 - RNA, 25 nt, Homo sapiens
uuuagcgcccaguuggguggaugcc

SEQ ID NO: 7588 - RNA, 25 nt, Homo sapiens
agcgcccaguuggguggaugccugg

SEQ ID NO: 7589 - RNA, 25 nt, Homo sapiens
uuggguggaugccugguggcagcug

SEQ ID NO: 7590 - RNA, 25 nt, Homo sapiens
gccugguggcagcugcgguccaccc

SEQ ID NO: 7591 - RNA, 25 nt, Homo sapiens
agcugcgguccacccaggagccccg

SEQ ID NO: 7592 - RNA, 25 nt, Homo sapiens
ccaggagccccgaggccuucucuga

SEQ ID NO: 7593 - RNA, 25 nt, Homo sapiens
ccgaggccuucucugaaggacauug

SEQ ID NO: 7594 - RNA, 25 nt, Homo sapiens
cucugaaggacauugcggacagcca

SEQ ID NO: 7595 - RNA, 25 nt, Homo sapiens
aaggacauugcggacagccacggcc

SEQ ID NO: 7596 - RNA, 25 nt, Homo sapiens
uugcggacagccacggccaggccag

SEQ ID NO: 7597 - RNA, 25 nt, Homo sapiens
ugcggacagccacggccaggccaga

SEQ ID NO: 7598 - RNA, 25 nt, Homo sapiens
acggccaggccagagggagugacag

SEQ ID NO: 7599 - RNA, 25 nt, Homo sapiens
agaggcagccccauucugccugccc

SEQ ID NO: 7600 - RNA, 25 nt, Homo sapiens
cugccugcccaggccccugccaccc

SEQ ID NO: 7601 - RNA, 25 nt, Homo sapiens
ugccugcccaggccccugccacccu

SEQ ID NO: 7602 - RNA, 25 nt, Homo sapiens
gccugcccaggccccugccacccug

SEQ ID NO: 7603 - RNA, 25 nt, Homo sapiens
cugcucuccgaccagacaccuugac

SEQ ID NO: 7604 - RNA, 25 nt, Homo sapiens
ugcucuccgaccagacaccuugaca

SEQ ID NO: 7605 - RNA, 25 nt, Homo sapiens
gaccagacaccuugacagggcacac

SEQ ID NO: 7606 - RNA, 25 nt, Homo sapiens
accagacaccuugacagggcacacc

SEQ ID NO: 7607 - RNA, 25 nt, Homo sapiens
acaccgggcacucagaagacacuga

SEQ ID NO: 7608 - RNA, 25 nt, Homo sapiens
caccgggcacucagaagacacugau

SEQ ID NO: 7609 - RNA, 25 nt, Homo sapiens
gccugcuaauuccccagauugcaac

SEQ ID NO: 7610 - RNA, 25 nt, Homo sapiens
gcuaauuccccagauugcaacaggc

SEQ ID NO: 7611 - RNA, 25 nt, Homo sapiens
cuaauuccccagauugcaacaggcu

SEQ ID NO: 7612 - RNA, 25 nt, Homo sapiens
cagauugcaacaggcugggcuucag

SEQ ID NO: 7613 - RNA, 25 nt, Homo sapiens
cuucaguggcagcugcuuuugucua

SEQ ID NO: 7614 - RNA, 25 nt, Homo sapiens
uucaguggcagcugcuuuugucuau

SEQ ID NO: 7615 - RNA, 25 nt, Homo sapiens
augggacucaaugcacugacauugu

SEQ ID NO: 7616 - RNA, 25 nt, Homo sapiens
gacauuguuggccaaagccaaagcu

SEQ ID NO: 7617 - RNA, 25 nt, Homo sapiens
uguuggccaaagccaaagcuaggcc

SEQ ID NO: 7618 - RNA, 25 nt, Homo sapiens
cuggccagaugcaccagcccuuagc

SEQ ID NO: 7619 - RNA, 25 nt, Homo sapiens
uggccagaugcaccagcccuuagca

SEQ ID NO: 7620 - RNA, 25 nt, Homo sapiens
cagcccuuagcagggaaacagcuaa

SEQ ID NO: 7621 - RNA, 25 nt, Homo sapiens
agcccuuagcagggaaacagcuaau

SEQ ID NO: 7622 - RNA, 25 nt, Homo sapiens
agggaaacagcuaaugggacacuaa

SEQ ID NO: 7623 - RNA, 25 nt, Homo sapiens
gggaaacagcuaaugggacacuaau

SEQ ID NO: 7624 - RNA, 25 nt, Homo sapiens
ggaaacagcuaaugggacacuaaug

SEQ ID NO: 7625 - RNA, 25 nt, Homo sapiens
aacagcuaaugggacacuaaugggg

SEQ ID NO: 7626 - RNA, 25 nt, Homo sapiens
aaugggacacuaauggggcggugag

SEQ ID NO: 7627 - RNA, 25 nt, Homo sapiens
augggacacuaauggggcggugaga

SEQ ID NO: 7628 - RNA, 25 nt, Homo sapiens
ugggacacuaauggggcggugagag

SEQ ID NO: 7629 - RNA, 25 nt, Homo sapiens
auggggcggugagaggggaacagac

SEQ ID NO: 7630 - RNA, 25 nt, Homo sapiens
auuauaaaugucucuuuaaugucac

SEQ ID NO: 7631 - RNA, 25 nt, Homo sapiens
uaaaugucucuuuaaugucacaggc

SEQ ID NO: 7632 - RNA, 25 nt, Homo sapiens
ucucuuuaaugucacaggcaggucc

SEQ ID NO: 7633 - RNA, 25 nt, Homo sapiens
cucuuuaaugucacaggcaggucca

SEQ ID NO: 7634 - RNA, 25 nt, Homo sapiens
uugaguucauacccuguuaccauuu

SEQ ID NO: 7635 - RNA, 25 nt, Homo sapiens
ugaguucauacccuguuaccauuuu

SEQ ID NO: 7636 - RNA, 25 nt, Homo sapiens
gaguucauacccuguuaccauuuug

SEQ ID NO: 7637 - RNA, 25 nt, Homo sapiens
agaacaugcuguagcgggaggagcc

SEQ ID NO: 7638 - RNA, 25 nt, Homo sapiens
uccucagagaacaugcuguagcggg

SEQ ID NO: 7639 - RNA, 25 nt, Homo sapiens
guguccucagagaacaugcuguagc

SEQ ID NO: 7640 - RNA, 25 nt, Homo sapiens
aguguccucagagaacaugcuguag

SEQ ID NO: 7641 - RNA, 25 nt, Homo sapiens
caaguacccaguucaagguccagcg

SEQ ID NO: 7642 - RNA, 25 nt, Homo sapiens
gcuguguccacaaguacccaguuca

SEQ ID NO: 7643 - RNA, 25 nt, Homo sapiens
augcugaggcucaugggauacagcc

SEQ ID NO: 7644 - RNA, 25 nt, Homo sapiens
cgggugccaggaugcugaggcucau

SEQ ID NO: 7645 - RNA, 25 nt, Homo sapiens
ccgggugccaggaugcugaggcuca

SEQ ID NO: 7646 - RNA, 25 nt, Homo sapiens
gcaggggccgggugccaggaugcug

SEQ ID NO: 7647 - RNA, 25 nt, Homo sapiens
ccugaaccagcaggggccgggugcc

SEQ ID NO: 7648 - RNA, 25 nt, Homo sapiens
ggccaacccugaaccagcaggggcc

SEQ ID NO: 7649 - RNA, 25 nt, Homo sapiens
gggccaacccugaaccagcaggggc

SEQ ID NO: 7650 - RNA, 25 nt, Homo sapiens
gcaggggccaacccugaaccagcag

SEQ ID NO: 7651 - RNA, 25 nt, Homo sapiens
ggcaggggccaacccugaaccagca

SEQ ID NO: 7652 - RNA, 25 nt, Homo sapiens
gggcaggggccaacccugaaccagc

SEQ ID NO: 7653 - RNA, 25 nt, Homo sapiens
ugugguucauuccgcagccgggcag

SEQ ID NO: 7654 - RNA, 25 nt, Homo sapiens
augugguucauuccgcagccgggca

SEQ ID NO: 7655 - RNA, 25 nt, Homo sapiens
gaugugguucauuccgcagccgggc

SEQ ID NO: 7656 - RNA, 25 nt, Homo sapiens
gcaagaugugguucauuccgcagcc

SEQ ID NO: 7657 - RNA, 25 nt, Homo sapiens
agcaagaugugguucauuccgcagc

SEQ ID NO: 7658 - RNA, 25 nt, Homo sapiens
cugugucugucagcagagcaagaug

SEQ ID NO: 7659 - RNA, 25 nt, Homo sapiens
cugggcgcuaaaggagccuggagcc

SEQ ID NO: 7660 - RNA, 25 nt, Homo sapiens
acugggcgcuaaaggagccuggagc

SEQ ID NO: 7661 - RNA, 25 nt, Homo sapiens
cacccaacugggcgcuaaaggagcc

SEQ ID NO: 7662 - RNA, 25 nt, Homo sapiens
aggcauccacccaacugggcgcuaa

SEQ ID NO: 7663 - RNA, 25 nt, Homo sapiens
gcugccaccaggcauccacccaacu

SEQ ID NO: 7664 - RNA, 25 nt, Homo sapiens
agcugccaccaggcauccacccaac

SEQ ID NO: 7665 - RNA, 25 nt, Homo sapiens
uccuggguggaccgcagcugccacc

SEQ ID NO: 7666 - RNA, 25 nt, Homo sapiens
cagagaaggccucggggcuccuggg

SEQ ID NO: 7667 - RNA, 25 nt, Homo sapiens
cuucagagaaggccucggggcuccu

SEQ ID NO: 7668 - RNA, 25 nt, Homo sapiens
ccuucagagaaggccucggggcucc

SEQ ID NO: 7669 - RNA, 25 nt, Homo sapiens
gcaauguccuucagagaaggccucg

SEQ ID NO: 7670 - RNA, 25 nt, Homo sapiens
cgcaauguccuucagagaaggccuc

SEQ ID NO: 7671 - RNA, 25 nt, Homo sapiens
ccgcaauguccuucagagaaggccu

SEQ ID NO: 7672 - RNA, 25 nt, Homo sapiens
ggcuguccgcaauguccuucagaga

SEQ ID NO: 7673 - RNA, 25 nt, Homo sapiens
ucugucacucccucuggccuggccg

SEQ ID NO: 7674 - RNA, 25 nt, Homo sapiens
gcugccucugucacucccucuggcc

SEQ ID NO: 7675 - RNA, 25 nt, Homo sapiens
auggggcugccucugucacucccuc

SEQ ID NO: 7676 - RNA, 25 nt, Homo sapiens
ggcaggggccugggcaggcagaaug

SEQ ID NO: 7677 - RNA, 25 nt, Homo sapiens
uggcaggggccugggcaggcagaau

SEQ ID NO: 7678 - RNA, 25 nt, Homo sapiens
guggcaggggccugggcaggcagaa

SEQ ID NO: 7679 - RNA, 25 nt, Homo sapiens
uccccaggguggcaggggccugggc

SEQ ID NO: 7680 - RNA, 25 nt, Homo sapiens
uuucuccccaggguggcaggggccu

SEQ ID NO: 7681 - RNA, 25 nt, Homo sapiens
cuuucuccccaggguggcaggggcc

SEQ ID NO: 7682 - RNA, 25 nt, Homo sapiens
uuguacuuucuccccaggguggcag

SEQ ID NO: 7683 - RNA, 25 nt, Homo sapiens
cuuguacuuucuccccaggguggca

SEQ ID NO: 7684 - RNA, 25 nt, Homo sapiens
ucuuguacuuucuccccaggguggc

SEQ ID NO: 7685 - RNA, 25 nt, Homo sapiens
uuuuucuuguacuuucuccccaggg

SEQ ID NO: 7686 - RNA, 25 nt, Homo sapiens
uuuuuuuucuuguacuuucucccca

SEQ ID NO: 7687 - RNA, 25 nt, Homo sapiens
uuuuuuuuucuuguacuuucucccc

SEQ ID NO: 7688 - RNA, 25 nt, Homo sapiens
caaggugucuggucggagagcaggg

SEQ ID NO: 7689 - RNA, 25 nt, Homo sapiens
ugucaaggugucuggucggagagca

SEQ ID NO: 7690 - RNA, 25 nt, Homo sapiens
cugucaaggugucuggucggagagc

SEQ ID NO: 7691 - RNA, 25 nt, Homo sapiens
ggugugcccugucaaggugucuggu

SEQ ID NO: 7692 - RNA, 25 nt, Homo sapiens
gcccggugugcccugucaagguguc

SEQ ID NO: 7693 - RNA, 25 nt, Homo sapiens
ucugagugcccggugugcccuguca

SEQ ID NO: 7694 - RNA, 25 nt, Homo sapiens
ugcccaucagugucuucugagugcc

SEQ ID NO: 7695 - RNA, 25 nt, Homo sapiens
gcaaucuggggaauuagcaggcugg

SEQ ID NO: 7696 - RNA, 25 nt, Homo sapiens
ugcaaucuggggaauuagcaggcug

SEQ ID NO: 7697 - RNA, 25 nt, Homo sapiens
uugcaaucuggggaauuagcaggcu

SEQ ID NO: 7698 - RNA, 25 nt, Homo sapiens
guugcaaucuggggaauuagcaggc

SEQ ID NO: 7699 - RNA, 25 nt, Homo sapiens
gccuguugcaaucuggggaauuagc

SEQ ID NO: 7700 - RNA, 25 nt, Homo sapiens
cugaagcccagccuguugcaaucug

SEQ ID NO: 7701 - RNA, 25 nt, Homo sapiens
acugaagcccagccuguugcaaucu

SEQ ID NO: 7702 - RNA, 25 nt, Homo sapiens
cacugaagcccagccuguugcaauc

SEQ ID NO: 7703 - RNA, 25 nt, Homo sapiens
aucuggccaggccuagcuuuggcuu

SEQ ID NO: 7704 - RNA, 25 nt, Homo sapiens
uggugcaucuggccaggccuagcuu

SEQ ID NO: 7705 - RNA, 25 nt, Homo sapiens
cugcuaagggcuggugcaucuggcc

SEQ ID NO: 7706 - RNA, 25 nt, Homo sapiens
uuucccugcuaagggcuggugcauc

SEQ ID NO: 7707 - RNA, 25 nt, Homo sapiens
cauuagcuguuucccugcuaagggc

SEQ ID NO: 7708 - RNA, 25 nt, Homo sapiens
gucccauuagcuguuucccugcuaa

SEQ ID NO: 7709 - RNA, 25 nt, Homo sapiens
ugucccauuagcuguuucccugcua

SEQ ID NO: 7710 - RNA, 25 nt, Homo sapiens
uuuauaauguagugaaaaaagacac

SEQ ID NO: 7711 - RNA, 25 nt, Homo sapiens
gguaacaggguaugaacucaaaccc

SEQ ID NO: 7712 - RNA, 25 nt, Homo sapiens
guguggguaccccaaaaugguaaca

SEQ ID NO: 7713 - RNA, 25 nt, Homo sapiens
cguguggguaccccaaaaugguaac

SEQ ID NO: 7714 - RNA, 25 nt, Homo sapiens
uuggucucguguggguaccccaaaa

SEQ ID NO: 7715 - RNA, 25 nt, Homo sapiens
aauguauaaucuauuggucucgugu

SEQ ID NO: 7716 - RNA, 25 nt, Homo sapiens
caauguauaaucuauuggucucgug

SEQ ID NO: 7717 - RNA, 20 nt, Homo sapiens
ggcauccuuggggaagcuga

SEQ ID NO: 7718 - RNA, 20 nt, Homo sapiens
ucgugcccucagcuucccca

SEQ ID NO: 7719 - RNA, 20 nt, Homo sapiens
uuggggaagcugagggcacg

SEQ ID NO: 7720 - RNA, 20 nt, Homo sapiens
gggaagcugagggcacgagg

SEQ ID NO: 7721 - RNA, 20 nt, Homo sapiens
ggaagcugagggcacgagga

SEQ ID NO: 7722 - RNA, 20 nt, Homo sapiens
gaagcugagggcacgaggag

SEQ ID NO: 7723 - RNA, 20 nt, Homo sapiens
gaggaggggcugccagacuc

SEQ ID NO: 7724 - RNA, 20 nt, Homo sapiens
aggaggggcugccagacucc

SEQ ID NO: 7725 - RNA, 20 nt, Homo sapiens
aggcagcagcucccggaguc

SEQ ID NO: 7726 - RNA, 20 nt, Homo sapiens
agacuccgggagcugcugcc

SEQ ID NO: 7727 - RNA, 20 nt, Homo sapiens
uccgggagcugcugccuggc

SEQ ID NO: 7728 - RNA, 20 nt, Homo sapiens
ccgggagcugcugccuggcu

SEQ ID NO: 7729 - RNA, 20 nt, Homo sapiens
cccagccaggcagcagcucc

SEQ ID NO: 7730 - RNA, 20 nt, Homo sapiens
auuguguaggaaucccagcc

SEQ ID NO: 7731 - RNA, 20 nt, Homo sapiens
uuccuacacaaugcguugcc

SEQ ID NO: 7732 - RNA, 20 nt, Homo sapiens
agccaggcaacgcauugugu

SEQ ID NO: 7733 - RNA, 20 nt, Homo sapiens
ugccuggcuccacgcccugc

SEQ ID NO: 7734 - RNA, 20 nt, Homo sapiens
gccuggcuccacgcccugcu

SEQ ID NO: 7735 - RNA, 20 nt, Homo sapiens
acccagcagggcguggagcc

SEQ ID NO: 7736 - RNA, 20 nt, Homo sapiens
agguaggacccagcagggcg

SEQ ID NO: 7737 - RNA, 20 nt, Homo sapiens
cugacagguaggacccagca

SEQ ID NO: 7738 - RNA, 20 nt, Homo sapiens
ucugacagguaggacccagc

SEQ ID NO: 7739 - RNA, 20 nt, Homo sapiens
cagcucacagugugccacca

SEQ ID NO: 7740 - RNA, 20 nt, Homo sapiens
acagugugccaccauggagu

SEQ ID NO: 7741 - RNA, 20 nt, Homo sapiens
cagugugccaccauggaguu

SEQ ID NO: 7742 - RNA, 20 nt, Homo sapiens
agugugccaccauggaguug

SEQ ID NO: 7743 - RNA, 20 nt, Homo sapiens
uaggggccccaacuccaugg

SEQ ID NO: 7744 - RNA, 20 nt, Homo sapiens
uucuaggggccccaacucca

SEQ ID NO: 7745 - RNA, 20 nt, Homo sapiens
auggaguuggggccccuaga

SEQ ID NO: 7746 - RNA, 20 nt, Homo sapiens
gaguuggggccccuagaagg

SEQ ID NO: 7747 - RNA, 20 nt, Homo sapiens
gccccuagaagguggcuacc

SEQ ID NO: 7748 - RNA, 20 nt, Homo sapiens
uccagguagccaccuucuag

SEQ ID NO: 7749 - RNA, 20 nt, Homo sapiens
cuccagguagccaccuucua

SEQ ID NO: 7750 - RNA, 20 nt, Homo sapiens
gcuccagguagccaccuucu

SEQ ID NO: 7751 - RNA, 20 nt, Homo sapiens
caucgcuguuaagaagcucc

SEQ ID NO: 7752 - RNA, 20 nt, Homo sapiens
agaagugguagaggcacagg

SEQ ID NO: 7753 - RNA, 20 nt, Homo sapiens
uagaagugguagaggcacag

SEQ ID NO: 7754 - RNA, 20 nt, Homo sapiens
auagaagugguagaggcaca

SEQ ID NO: 7755 - RNA, 20 nt, Homo sapiens
cauagaagugguagaggcac

SEQ ID NO: 7756 - RNA, 20 nt, Homo sapiens
ucuggucauagaagugguag

SEQ ID NO: 7757 - RNA, 20 nt, Homo sapiens
cuaccacuucuaugaccaga

SEQ ID NO: 7758 - RNA, 20 nt, Homo sapiens
gguccaucuggucauagaag

SEQ ID NO: 7759 - RNA, 20 nt, Homo sapiens
cuucuaugaccagauggacc

SEQ ID NO: 7760 - RNA, 20 nt, Homo sapiens
uaugaccagauggaccuggc

SEQ ID NO: 7761 - RNA, 20 nt, Homo sapiens
cuucuccagccagguccauc

SEQ ID NO: 7762 - RNA, 20 nt, Homo sapiens
caaucucuucuucuccagcc

SEQ ID NO: 7763 - RNA, 20 nt, Homo sapiens
caguugauggugucuguguc

SEQ ID NO: 7764 - RNA, 20 nt, Homo sapiens
gcaguugauggugucugugu

SEQ ID NO: 7765 - RNA, 20 nt, Homo sapiens
gcugaacuggucgcaguuga

SEQ ID NO: 7766 - RNA, 20 nt, Homo sapiens
ucaacugcgaccaguucagc

SEQ ID NO: 7767 - RNA, 20 nt, Homo sapiens
cacacaacagccugcugaac

SEQ ID NO: 7768 - RNA, 20 nt, Homo sapiens
cagcaggcuguugugugaca

SEQ ID NO: 7769 - RNA, 20 nt, Homo sapiens
aggcuguugugugacaugga

SEQ ID NO: 7770 - RNA, 20 nt, Homo sapiens
uggaaggugaugaagagacc

SEQ ID NO: 7771 - RNA, 20 nt, Homo sapiens
ggaaggugaugaagagacca

SEQ ID NO: 7772 - RNA, 20 nt, Homo sapiens
aggugaugaagagaccaggg

SEQ ID NO: 7773 - RNA, 20 nt, Homo sapiens
gauauuggcauaagccuccc

SEQ ID NO: 7774 - RNA, 20 nt, Homo sapiens
aggugcuuccucaccgauau

SEQ ID NO: 7775 - RNA, 20 nt, Homo sapiens
acuggaccaguaugucuucc

SEQ ID NO: 7776 - RNA, 20 nt, Homo sapiens
gggaguccuggaagacauac

SEQ ID NO: 7777 - RNA, 20 nt, Homo sapiens
ugucuuccaggacucccagc

SEQ ID NO: 7778 - RNA, 20 nt, Homo sapiens
cuuccaggacucccagcugg

SEQ ID NO: 7779 - RNA, 20 nt, Homo sapiens
uuccaggacucccagcugga

SEQ ID NO: 7780 - RNA, 20 nt, Homo sapiens
ggcccuccagcugggagucc

SEQ ID NO: 7781 - RNA, 20 nt, Homo sapiens
cuugcucaggcccuccagcu

SEQ ID NO: 7782 - RNA, 20 nt, Homo sapiens
ccuugcucaggcccuccagc

SEQ ID NO: 7783 - RNA, 20 nt, Homo sapiens
ccagcuggagggccugagca

SEQ ID NO: 7784 - RNA, 20 nt, Homo sapiens
uacugaaaauguccuugcuc

SEQ ID NO: 7785 - RNA, 20 nt, Homo sapiens
auaggaccagaugaagugau

SEQ ID NO: 7786 - RNA, 20 nt, Homo sapiens
cucucaccgaucacuucauc

SEQ ID NO: 7787 - RNA, 20 nt, Homo sapiens
ugaagugaucggugagagua

SEQ ID NO: 7788 - RNA, 20 nt, Homo sapiens
auggagaugccagcagaagu

SEQ ID NO: 7789 - RNA, 20 nt, Homo sapiens
uggagaugccagcagaaguu

SEQ ID NO: 7790 - RNA, 20 nt, Homo sapiens
cuuuucugcccaacuucugc

SEQ ID NO: 7791 - RNA, 20 nt, Homo sapiens
ugccggaagcuccucuggga

SEQ ID NO: 7792 - RNA, 20 nt, Homo sapiens
ggucugccggaagcuccucu

SEQ ID NO: 7793 - RNA, 20 nt, Homo sapiens
aggucugccggaagcuccuc

SEQ ID NO: 7794 - RNA, 20 nt, Homo sapiens
uuccggcagaccugaagcac

SEQ ID NO: 7795 - RNA, 20 nt, Homo sapiens
uuccagugcuucaggucugc

SEQ ID NO: 7796 - RNA, 20 nt, Homo sapiens
gagccccccacuguggugac

SEQ ID NO: 7797 - RNA, 20 nt, Homo sapiens
cugccagucaccacaguggg

SEQ ID NO: 7798 - RNA, 20 nt, Homo sapiens
acugccagucaccacagugg

SEQ ID NO: 7799 - RNA, 20 nt, Homo sapiens
gacugccagucaccacagug

SEQ ID NO: 7800 - RNA, 20 nt, Homo sapiens
agacugccagucaccacagu

SEQ ID NO: 7801 - RNA, 20 nt, Homo sapiens
gagacugccagucaccacag

SEQ ID NO: 7802 - RNA, 20 nt, Homo sapiens
ggugacuggcagucuccuag

SEQ ID NO: 7803 - RNA, 20 nt, Homo sapiens
gugacuggcagucuccuagu

SEQ ID NO: 7804 - RNA, 20 nt, Homo sapiens
agucgcucacuggucccacu

SEQ ID NO: 7805 - skipped

SEQ ID NO: 7806 - RNA, 16 nt, Artificial Sequence
  source: /note="Description of Artificial Sequence: Synthetic oligonucleotide"
guuuuagagcuaugcu

SEQ ID NO: 7807 - RNA, 90 nt, Artificial Sequence
  source: /note="Description of Artificial Sequence: Synthetic oligonucleotide"
guuuaagagcuaugcuggaaacagcauagcaaguuuaaauaaggcuaguccguuaucaacuugaaaaaguggcaccgagucggugcuuuu

SEQ ID NO: 7808 - RNA, 67 nt, Artificial Sequence
  source: /note="Description of Artificial Sequence: Synthetic oligonucleotide"
agcauagcaaguuaaaauaaggcuaguccguuaucaacuugaaaaaguggcaccgagucggugcuuu

SEQ ID NO: 7809 - RNA, 85 nt, Artificial Sequence
  source: /note="Description of Artificial Sequence: Synthetic oligonucleotide"
guuggaaccauucaaaacagcauagcaaguuaaaauaaggcuaguccguuaucaacuugaaaaaguggcaccgagucggugcuuu

SEQ ID NO: 7810 - protein, 7 aa, Tobacco etch virus
ENLYFQG

SEQ ID NO: 7811 - RNA, 80 nt, Artificial Sequence
  source: /note="Description of Artificial Sequence: Synthetic oligonucleotide"
guuuuagagcuagaaauagcaaguuaaaauaaggcuaguccguuaucaacuugaaaaaguggcaccgagucggugcuuuu

SEQ ID NO: 7812 - protein, 243 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 7813 - protein, 243 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 7814 - protein, 243 aa, Artificial Sequence
  source: /note="Description of Artificial Sequence: Synthetic polypeptide"
QVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 7815 - protein, 245 aa, Artificial Sequence
  source: /note="Description of Artificial Sequence: Synthetic polypeptide"
QVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 7816 - protein, 487 aa, Artificial Sequence
  source: /note="Description of Artificial Sequence: Synthetic polypeptide"
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7817 - protein, 487 aa, Artificial Sequence
  source: /note="Description of Artificial Sequence: Synthetic polypeptide"
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7818 - protein, 336 aa, Artificial Sequence
  source: /note="Description of Artificial Sequence: Synthetic polypeptide"
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCK

SEQ ID NO: 7819 - protein, 487 aa, Artificial Sequence
  source: /note="Description of Artificial Sequence: Synthetic polypeptide"
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7820 - RNA, 67 nt, Artificial Sequence
  source: /note="Description of Artificial Sequence: Synthetic oligonucleotide"
aacagcauagcaaguuaaaauaaggcuaguccguuaucaacuugaaaaaguggcaccgagucggugc

SEQ ID NO: 7821 - protein, 1393 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVHHHHHH

SEQ ID NO: 7822 - protein, 1393 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRILYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIEEFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVHHHHHH

SEQ ID NO: 7823 - protein, 1399 aa, Artificial Sequence
  source: /note="Description of Artificial Sequence: Synthetic polypeptide"
MGSSHHHHHHHHENLYFQGSMDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSPKKKRKV

SEQ ID NO: 7824 - protein, 1396 aa, Artificial Sequence
  source: /note="Description of Artificial Sequence: Synthetic polypeptide"
MAHHHHHHGGSPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKV

SEQ ID NO: 7825 - protein, 1386 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADHHHHHH

SEQ ID NO: 7826 - protein, 1389 aa, Artificial Sequence
  source: /note="Description of Artificial Sequence: Synthetic polypeptide"
MAHHHHHHGGSDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKV

SEQ ID NO: 7827 - protein, 1399 aa, Artificial Sequence; identical to SEQ ID NO: 7823
  source: /note="Description of Artificial Sequence: Synthetic polypeptide"

SEQ ID NO: 7828 - protein, 1393 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNAVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVHHHHHH

SEQ ID NO: 7829 - protein, 1393 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEALYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPALESEFVYGDYKVYDVRKMIAKSEQEIGKATAKYFFYSNIMNFFKTEITLANGEIRKAPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVHHHHHH

SEQ ID NO: 7830 - protein, 1393 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLADDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPALESEFVYGDYKVYDVRKMIAKSEQEIGKATAKYFFYSNIMNFFKTEITLANGEIRKAPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVHHHHHH

SEQ ID NO: 7831 - protein, 1393 aa, Artificial Sequence
  source: /note="Description of Artificial Sequence: Synthetic polypeptide"
MAPKKKRKVDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKVHHHHHH

SEQ ID NO: 7832 - skipped

SEQ ID NO: 7833 - RNA, 100 nt, Artificial Sequence
  source: /note="Description of Artificial Sequence: Synthetic polynucleotide"
agagucucucagcugguacaguuuuagagcuagaaauagcaaguuaaaauaaggcuaguccguuaucaacuugaaaaaguggcaccgagucggugcuuuu

SEQ ID NO: 7834 - RNA, 100 nt, Artificial Sequence; identical to SEQ ID NO: 7833
  source: /note="Description of Artificial Sequence: Synthetic polynucleotide"

SEQ ID NO: 7835 - RNA, 100 nt, Artificial Sequence; identical to SEQ ID NO: 7833
  source: /note="Description of Artificial Sequence: Synthetic polynucleotide"

SEQ ID NO: 7836 - RNA, 42 nt, Artificial Sequence
  source: /note="Description of Artificial Sequence: Synthetic oligonucleotide"
agagucucucagcugguacaguuuuagagcuaugcuguuuug

SEQ ID NO: 7837 - RNA, 42 nt, Artificial Sequence; identical to SEQ ID NO: 7836
  source: /note="Description of Artificial Sequence: Synthetic oligonucleotide"

SEQ ID NO: 7838 - RNA, 100 nt, Artificial Sequence
  source: /note="Description of Artificial Sequence: Synthetic polynucleotide"
uucggaacccaaucacugacguuuuagagcuagaaauagcaaguuaaaauaaggcuaguccguuaucaacuugaaaaaguggcaccgagucggugcuuuu

SEQ ID NO: 7839 - RNA, 100 nt, Artificial Sequence; identical to SEQ ID NO: 7838
  source: /note="Description of Artificial Sequence: Synthetic polynucleotide"

SEQ ID NO: 7840 - RNA, 100 nt, Artificial Sequence; identical to SEQ ID NO: 7838
  source: /note="Description of Artificial Sequence: Synthetic polynucleotide"

SEQ ID NO: 7841 - RNA, 42 nt, Artificial Sequence
  source: /note="Description of Artificial Sequence: Synthetic oligonucleotide"
uucggaacccaaucacugacguuuuagagcuaugcuguuuug

SEQ ID NO: 7842 - RNA, 42 nt, Artificial Sequence; identical to SEQ ID NO: 7841
  source: /note="Description of Artificial Sequence: Synthetic oligonucleotide"

SEQ ID NO: 7843 - RNA, 100 nt, Artificial Sequence
  source: /note="Description of Artificial Sequence: Synthetic polynucleotide"
uggcucaaacacagcgaccuguuuuagagcuagaaauagcaaguuaaaauaaggcuaguccguuaucaacuugaaaaaguggcaccgagucggugcuuuu

SEQ ID NO: 7844 - RNA, 100 nt, Artificial Sequence; identical to SEQ ID NO: 7843
  source: /note="Description of Artificial Sequence: Synthetic polynucleotide"

SEQ ID NO: 7845 - RNA, 100 nt, Artificial Sequence; identical to SEQ ID NO: 7843
  source: /note="Description of Artificial Sequence: Synthetic polynucleotide"

SEQ ID NO: 7846 - RNA, 42 nt, Artificial Sequence
  source: /note="Description of Artificial Sequence: Synthetic oligonucleotide"
uggcucaaacacagcgaccuguuuuagagcuaugcuguuuug

SEQ ID NO: 7847 - RNA, 42 nt, Artificial Sequence; identical to SEQ ID NO: 7846
  source: /note="Description of Artificial Sequence: Synthetic oligonucleotide"

SEQ ID NO: 7848 - RNA, 100 nt, Artificial Sequence
  source: /note="Description of Artificial Sequence: Synthetic polynucleotide"
ucccuagcaagaucucauagguuuuagagcuagaaauagcaaguuaaaauaaggcuaguccguuaucaacuugaaaaaguggcaccgagucggugcuuuu

SEQ ID NO: 7849 - RNA, 100 nt, Artificial Sequence; identical to SEQ ID NO: 7848
  source: /note="Description of Artificial Sequence: Synthetic polynucleotide"

SEQ ID NO: 7850 - RNA, 100 nt, Artificial Sequence; identical to SEQ ID NO: 7848
  source: /note="Description of Artificial Sequence: Synthetic polynucleotide"

SEQ ID NO: 7851 - RNA, 42 nt, Artificial Sequence
  source: /note="Description of Artificial Sequence: Synthetic oligonucleotide"
ucccuagcaagaucucauagguuuuagagcuaugcuguuuug

SEQ ID NO: 7852 - RNA, 42 nt, Artificial Sequence; identical to SEQ ID NO: 7851
  source: /note="Description of Artificial Sequence: Synthetic oligonucleotide"

SEQ ID NO: 7853 - RNA, 100 nt, Artificial Sequence
  source: /note="Description of Artificial Sequence: Synthetic polynucleotide"
ggccacggagcgagacaucuguuuuagagcuagaaauagcaaguuaaaauaaggcuaguccguuaucaacuugaaaaaguggcaccgagucggugcuuuu

SEQ ID NO: 7854 - RNA, 100 nt, Artificial Sequence; identical to SEQ ID NO: 7853
  source: /note="Description of Artificial Sequence: Synthetic polynucleotide"

SEQ ID NO: 7855 - RNA, 100 nt, Artificial Sequence; identical to SEQ ID NO: 7853
  source: /note="Description of Artificial Sequence: Synthetic polynucleotide"

SEQ ID NO: 7856 - RNA, 42 nt, Artificial Sequence
  source: /note="Description of Artificial Sequence: Synthetic oligonucleotide"
ggccacggagcgagacaucuguuuuagagcuaugcuguuuug

SEQ ID NO: 7857 - RNA, 42 nt, Artificial Sequence; identical to SEQ ID NO: 7856
  source: /note="Description of Artificial Sequence: Synthetic oligonucleotide"

SEQ ID NO: 7858 - RNA, 100 nt, Artificial Sequence
  source: /note="Description of Artificial Sequence: Synthetic polynucleotide"
gaguagcgcgagcacagcuaguuuuagagcuagaaauagcaaguuaaaauaaggcuaguccguuaucaacuugaaaaaguggcaccgagucggugcuuuu

SEQ ID NO: 7859 - RNA, 99 nt, Artificial Sequence
  source: /note="Description of Artificial Sequence: Synthetic oligonucleotide"
gauagcgcgagcacagcuaguuuuagagcuagaaauagcaaguuaaaauaaggcuaguccguuaucaacuugaaaaaguggcaccgagucggugcuuuu

SEQ ID NO: 7860 - RNA, 99 nt, Artificial Sequence; identical to SEQ ID NO: 7859
  source: /note="Description of Artificial Sequence: Synthetic oligonucleotide"

SEQ ID NO: 7861 - RNA, 42 nt, Artificial Sequence
  source: /note="Description of Artificial Sequence: Synthetic oligonucleotide"
gaguagcgcgagcacagcuaguuuuagagcuaugcuguuuug

SEQ ID NO: 7862 - RNA, 41 nt, Artificial Sequence
  source: /note="Description of Artificial Sequence: Synthetic oligonucleotide"
gauagcgcgagcacagcuaguuuuagagcuaugcuguuuug

SEQ ID NO: 7863 - RNA, 100 nt, Artificial Sequence
  source: /note="Description of Artificial Sequence: Synthetic polynucleotide"
caagcgcggccagaccugcgguuuuagagcuagaaauagcaaguuaaaauaaggcuaguccguuaucaacuugaaaaaguggcaccgagucggugcuuuu

SEQ ID NO: 7864 - RNA, 100 nt, Artificial Sequence; identical to SEQ ID NO: 7863
  source: /note="Description of Artificial Sequence: Synthetic polynucleotide"

SEQ ID NO: 7865 - RNA, 100 nt, Artificial Sequence; identical to SEQ ID NO: 7863
  source: /note="Description of Artificial Sequence: Synthetic polynucleotide"

SEQ ID NO: 7866 - RNA, 42 nt, Artificial Sequence
  source: /note="Description of Artificial Sequence: Synthetic oligonucleotide"
caagcgcggccagaccugcgguuuuagagcuaugcuguuuug

SEQ ID NO: 7867 - RNA, 42 nt, Artificial Sequence; identical to SEQ ID NO: 7866
  source: /note="Description of Artificial Sequence: Synthetic oligonucleotide"

SEQ ID NO: 7868 - RNA, 100 nt, Artificial Sequence
  source: /note="Description of Artificial Sequence: Synthetic polynucleotide"
ccgcugggcccccgacucacguuuuagagcuagaaauagcaaguuaaaauaaggcuaguccguuaucaacuugaaaaaguggcaccgagucggugcuuuu

SEQ ID NO: 7869 - RNA, 100 nt, Artificial Sequence; identical to SEQ ID NO: 7868
  source: /note="Description of Artificial Sequence: Synthetic polynucleotide"

SEQ ID NO: 7870 - RNA, 100 nt, Artificial Sequence; identical to SEQ ID NO: 7868
  source: /note="Description of Artificial Sequence: Synthetic polynucleotide"

SEQ ID NO: 7871 - RNA, 42 nt, Artificial Sequence
  source: /note="Description of Artificial Sequence: Synthetic oligonucleotide"
ccgcugggcccccgacucacguuuuagagcuaugcuguuuug

SEQ ID NO: 7872 - RNA, 42 nt, Artificial Sequence; identical to SEQ ID NO: 7871
  source: /note="Description of Artificial Sequence: Synthetic oligonucleotide"

SEQ ID NO: 7873-7882 - skipped (10 entries)

SEQ ID NO: 7883 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 7884 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 7885 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 7886 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 7887 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 7888 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 7889 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 7890 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 7891 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 7892 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 7893 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 7894 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 7895 - protein, 242 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 7896 - protein, 119 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVT

SEQ ID NO: 7897 - protein, 111 aa, Artificial Sequence
  source: /note="Description of Artificial Sequence: Synthetic polypeptide"
ELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 7898 - protein, 248 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGSTSGSGKPGSGEGSTKGELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 7899 - protein, 10 aa, Artificial Sequence
  source: /note="Description of Artificial Sequence: Synthetic peptide"
GVSLPDYGVS

SEQ ID NO: 7900 - protein, 16 aa, Artificial Sequence
  source: /note="Description of Artificial Sequence: Synthetic peptide"
VIWGSETTYYNSALKS

SEQ ID NO: 7901 - protein, 16 aa, Artificial Sequence
  source: /note="Description of Artificial Sequence: Synthetic peptide"
VIWGSETTYYSSSLKS

SEQ ID NO: 7902 - protein, 16 aa, Artificial Sequence
  source: /note="Description of Artificial Sequence: Synthetic peptide"
VIWGSETTYYQSSLKS

SEQ ID NO: 7903 - protein, 16 aa, Artificial Sequence
  source: /note="Description of Artificial Sequence: Synthetic peptide"
VIWGSETTYYNSSLKS

SEQ ID NO: 7904 - protein, 12 aa, Artificial Sequence
  source: /note="Description of Artificial Sequence: Synthetic peptide"
HYYYGGSYAMDY

SEQ ID NO: 7905 - protein, 11 aa, Artificial Sequence
  source: /note="Description of Artificial Sequence: Synthetic peptide"
RASQDISKYLN

SEQ ID NO: 7906 - protein, 7 aa, Artificial Sequence
  source: /note="Description of Artificial Sequence: Synthetic peptide"
HTSRLHS

SEQ ID NO: 7907 - protein, 9 aa, Artificial Sequence
  source: /note="Description of Artificial Sequence: Synthetic peptide"
QQGNTLPYT

SEQ ID NO: 7908 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7909 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7910 - protein, 486 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7911 - protein, 486 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7912 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7913 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7914 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7915 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7916 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7917 - protein, 491 aa, Artificial Sequence; identical to SEQ ID NO: 7916
  source: /note="Description of Artificial Sequence: Synthetic polypeptide"

SEQ ID NO: 7918 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7919 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7920 - protein, 486 aa, Artificial Sequence
  source: /note="Description of Artificial Sequence: Synthetic polypeptide"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7921-7938 - skipped (18 entries)

SEQ ID NO: 7939 - protein, 246 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 7940 - protein, 244 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 7941 - protein, 243 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 7942 - protein, 249 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 7943 - protein, 246 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 7944 - protein, 247 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 7945 - protein, 238 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 7946 - protein, 239 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 7947 - protein, 241 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 7948 - protein, 239 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 7949 - protein, 239 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 7950 - protein, 246 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 7951 - protein, 239 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 7952 - protein, 240 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 7953 - protein, 241 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 7954 - DNA, 738 bp, Artificial Sequence
  source: /note="Description of Artificial Sequence: Synthetic polynucleotide"
caagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaag

SEQ ID NO: 7955 - DNA, 732 bp, Artificial Sequence
  source: /note="Description of Artificial Sequence: Synthetic polynucleotide"
caagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaag

SEQ ID NO: 7956 - DNA, 729 bp, Artificial Sequence
  source: /note="Description of Artificial Sequence: Synthetic polynucleotide"
gaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaag

SEQ ID NO: 7957 - DNA, 747 bp, Artificial Sequence
  source: /note="Description of Artificial Sequence: Synthetic polynucleotide"
caagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaag

SEQ ID NO: 7958 - DNA, 738 bp, Artificial Sequence
  source: /note="Description of Artificial Sequence: Synthetic polynucleotide"
caagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaag

SEQ ID NO: 7959 - DNA, 741 bp, Artificial Sequence
  source: /note="Description of Artificial Sequence: Synthetic polynucleotide"
caagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaag

SEQ ID NO: 7960 - DNA, 714 bp, Artificial Sequence
  source: /note="Description of Artificial Sequence: Synthetic polynucleotide"
gaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaag

SEQ ID NO: 7961 - DNA, 717 bp, Artificial Sequence
  source: /note="Description of Artificial Sequence: Synthetic polynucleotide"
gaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaag

SEQ ID NO: 7962 - DNA, 723 bp, Artificial Sequence
  source: /note="Description of Artificial Sequence: Synthetic polynucleotide"
gaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaag

SEQ ID NO: 7963 - DNA, 717 bp, Artificial Sequence
  source: /note="Description of Artificial Sequence: Synthetic polynucleotide"
caagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaag

SEQ ID NO: 7964 - DNA, 717 bp, Artificial Sequence
  source: /note="Description of Artificial Sequence: Synthetic polynucleotide"
gaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaag

SEQ ID NO: 7965 - DNA, 738 bp, Artificial Sequence
  source: /note="Description of Artificial Sequence: Synthetic polynucleotide"
caagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaag

SEQ ID NO: 7966 - DNA, 717 bp, Artificial Sequence
  source: /note="Description of Artificial Sequence: Synthetic polynucleotide"
caagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaag

SEQ ID NO: 7967 - DNA, 720 bp, Artificial Sequence
  source: /note="Description of Artificial Sequence: Synthetic polynucleotide"
gaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaa

SEQ ID NO: 7968 - DNA, 723 bp, Artificial Sequence
  source: /note="Description of Artificial Sequence: Synthetic polynucleotide"
gaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaag

SEQ ID NO: 7969 - protein, 120 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSS

SEQ ID NO: 7970 - protein, 115 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSS

SEQ ID NO: 7971 - protein, 115 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 7972 - protein, 120 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSS

SEQ ID NO: 7973 - protein, 123 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSS

SEQ ID NO: 7974 - protein, 118 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSS

SEQ ID NO: 7975 - protein, 115 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 7976 - protein, 115 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 7977 - protein, 115 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 7978 - protein, 117 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSS

SEQ ID NO: 7979 - protein, 115 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 7980 - protein, 117 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSS

SEQ ID NO: 7981 - protein, 115 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 7982 - protein, 115 aa, Artificial Sequence; identical to SEQ ID NO: 7976
  source: /note="Description of Artificial Sequence: Synthetic polypeptide"

SEQ ID NO: 7983 - protein, 115 aa, Artificial Sequence; identical to SEQ ID NO: 7979
  source: /note="Description of Artificial Sequence: Synthetic polypeptide"

SEQ ID NO: 7984 - protein, 109 aa, Artificial Sequence
  source: /note="Description of Artificial Sequence: Synthetic polypeptide"
DIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 7985 - protein, 112 aa, Artificial Sequence
  source: /note="Description of Artificial Sequence: Synthetic polypeptide"
DIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 7986 - protein, 111 aa, Artificial Sequence
  source: /note="Description of Artificial Sequence: Synthetic polypeptide"
DIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 7987 - protein, 112 aa, Artificial Sequence
  source: /note="Description of Artificial Sequence: Synthetic polypeptide"
DIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 7988 - protein, 106 aa, Artificial Sequence
  source: /note="Description of Artificial Sequence: Synthetic polypeptide"
DIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 7989 - protein, 112 aa, Artificial Sequence
  source: /note="Description of Artificial Sequence: Synthetic polypeptide"
EIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 7990 - protein, 106 aa, Artificial Sequence
  source: /note="Description of Artificial Sequence: Synthetic polypeptide"
EIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 7991 - protein, 107 aa, Artificial Sequence
  source: /note="Description of Artificial Sequence: Synthetic polypeptide"
EIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 7992 - protein, 109 aa, Artificial Sequence
  source: /note="Description of Artificial Sequence: Synthetic polypeptide"
EIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 7993 - protein, 105 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 7994 - protein, 107 aa, Artificial Sequence
  source: /note="Description of Artificial Sequence: Synthetic polypeptide"
DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 7995 - protein, 112 aa, Artificial Sequence
  source: /note="Description of Artificial Sequence: Synthetic polypeptide"
DIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 7996 - protein, 107 aa, Artificial Sequence
  source: /note="Description of Artificial Sequence: Synthetic polypeptide"
DIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 7997 - protein, 108 aa, Artificial Sequence
  source: /note="Description of Artificial Sequence: Synthetic polypeptide"
ETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 7998 - protein, 109 aa, Artificial Sequence
  source: /note="Description of Artificial Sequence: Synthetic polypeptide"
EIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 7999-8028 - skipped (30 entries)

SEQ ID NO: 8029 - protein, 243 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 8030 - protein, 245 aa, Artificial Sequence
  source: /note="Description of Artificial Sequence: Synthetic polypeptide"
QVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 8031 - protein, 246 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 8032 - protein, 240 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 8033 - protein, 241 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 8034 - protein, 245 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 8035 - protein, 253 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 8036 - protein, 248 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 8037 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 8038 - protein, 241 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 8039 - protein, 248 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 8040 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 8041 - protein, 239 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 8042 - protein, 246 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 8043 - protein, 241 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 8044 - protein, 242 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 8045 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 8046 - protein, 244 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 8047 - protein, 244 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 8048 - protein, 251 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 8049 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 8050 - DNA, 729 bp, Artificial Sequence
  source: /note="Description of Artificial Sequence: Synthetic polynucleotide"
caagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaag

SEQ ID NO: 8051 - DNA, 735 bp, Artificial Sequence
  source: /note="Description of Artificial Sequence: Synthetic polynucleotide"
caagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaag

SEQ ID NO: 8052 - DNA, 738 bp, Artificial Sequence
  source: /note="Description of Artificial Sequence: Synthetic polynucleotide"
gaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaag

SEQ ID NO: 8053 - DNA, 720 bp, Artificial Sequence
  source: /note="Description of Artificial Sequence: Synthetic polynucleotide"
gaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctc

SEQ ID NO: 8054 - DNA, 723 bp, Artificial Sequence
  source: /note="Description of Artificial Sequence: Synthetic polynucleotide"
caagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtcctt

SEQ ID NO: 8055 - DNA, 735 bp, Artificial Sequence
  source: /note="Description of Artificial Sequence: Synthetic polynucleotide"
caagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaag

SEQ ID NO: 8056 - DNA, 759 bp, Artificial Sequence
  source: /note="Description of Artificial Sequence: Synthetic polynucleotide"
caagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctg

SEQ ID NO: 8057 - DNA, 744 bp, Artificial Sequence
  source: /note="Description of Artificial Sequence: Synthetic polynucleotide"
gaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctg

SEQ ID NO: 8058 - DNA, 738 bp, Artificial Sequence
  source: /note="Description of Artificial Sequence: Synthetic polynucleotide"
gaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaag

SEQ ID NO: 8059 - DNA, 723 bp, Artificial Sequence
  source: /note="Description of Artificial Sequence: Synthetic polynucleotide"
gaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaag

SEQ ID NO: 8060 - DNA, 744 bp, Artificial Sequence
  source: /note="Description of Artificial Sequence: Synthetic polynucleotide"
caagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaag

SEQ ID NO: 8061 - DNA, 744 bp, Artificial Sequence
  source: /note="Description of Artificial Sequence: Synthetic polynucleotide"
gaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaag

SEQ ID NO: 8062 - DNA, 717 bp, Artificial Sequence
  source: /note="Description of Artificial Sequence: Synthetic polynucleotide"
gaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaag

SEQ ID NO: 8063 - DNA, 738 bp, Artificial Sequence
  source: /note="Description of Artificial Sequence: Synthetic polynucleotide"
gaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaag

SEQ ID NO: 8064 - DNA, 723 bp, Artificial Sequence
  source: /note="Description of Artificial Sequence: Synthetic polynucleotide"
gaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaag

SEQ ID NO: 8065 - DNA, 726 bp, Artificial Sequence
  source: /note="Description of Artificial Sequence: Synthetic polynucleotide"
gaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaag

SEQ ID NO: 8066 - DNA, 744 bp, Artificial Sequence
  source: /note="Description of Artificial Sequence: Synthetic polynucleotide"
gaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaag

SEQ ID NO: 8067 - DNA, 732 bp, Artificial Sequence
  source: /note="Description of Artificial Sequence: Synthetic polynucleotide"
gaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaag

SEQ ID NO: 8068 - DNA, 733 bp, Artificial Sequence
  source: /note="Description of Artificial Sequence: Synthetic polynucleotide"
gaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaaga

SEQ ID NO: 8069 - DNA, 753 bp, Artificial Sequence
  source: /note="Description of Artificial Sequence: Synthetic polynucleotide"
caagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaag

SEQ ID NO: 8070 - DNA, 739 bp, Artificial Sequence
  source: /note="Description of Artificial Sequence: Synthetic polynucleotide"
gaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaa

SEQ ID NO: 8071 - protein, 121 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSS

SEQ ID NO: 8072 - protein, 123 aa, Artificial Sequence
  source: /note="Description of Artificial Sequence: Synthetic polypeptide"
QVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSS

SEQ ID NO: 8073 - protein, 119 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSS

SEQ ID NO: 8074 - protein, 117 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSS

SEQ ID NO: 8075 - protein, 120 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSS

SEQ ID NO: 8076 - protein, 123 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSS

SEQ ID NO: 8077 - protein, 129 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSS

SEQ ID NO: 8078 - protein, 125 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSS

SEQ ID NO: 8079 - protein, 118 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSS

SEQ ID NO: 8080 - protein, 118 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSS

SEQ ID NO: 8081 - protein, 124 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSS

SEQ ID NO: 8082 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSS

SEQ ID NO: 8083 - protein, 117 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSS

SEQ ID NO: 8084 - protein, 122 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSS

SEQ ID NO: 8085 - protein, 117 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSS

SEQ ID NO: 8086 - protein, 118 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSS

SEQ ID NO: 8087 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSS

SEQ ID NO: 8088 - protein, 120 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSS

SEQ ID NO: 8089 - protein, 117 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSS

SEQ ID NO: 8090 - protein, 126 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSS

SEQ ID NO: 8091 - protein, 122 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSS

SEQ ID NO: 8092 - protein, 107 aa, Artificial Sequence
  source: /note="Description of Artificial Sequence: Synthetic polypeptide"
ETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 8093 - protein, 107 aa, Artificial Sequence
  source: /note="Description of Artificial Sequence: Synthetic polypeptide"
DIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 8094 - protein, 112 aa, Artificial Sequence
  source: /note="Description of Artificial Sequence: Synthetic polypeptide"
EIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 8095 - protein, 108 aa, Artificial Sequence
  source: /note="Description of Artificial Sequence: Synthetic polypeptide"
SYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 8096 - protein, 106 aa, Artificial Sequence
  source: /note="Description of Artificial Sequence: Synthetic polypeptide"
SYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 8097 - protein, 107 aa, Artificial Sequence
  source: /note="Description of Artificial Sequence: Synthetic polypeptide"
DIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 8098 - protein, 109 aa, Artificial Sequence
  source: /note="Description of Artificial Sequence: Synthetic polypeptide"
SYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 8099 - protein, 108 aa, Artificial Sequence
  source: /note="Description of Artificial Sequence: Synthetic polypeptide"
SSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 8100 - protein, 113 aa, Artificial Sequence
  source: /note="Description of Artificial Sequence: Synthetic polypeptide"
EIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 8101 - protein, 108 aa, Artificial Sequence
  source: /note="Description of Artificial Sequence: Synthetic polypeptide"
EIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 8102 - protein, 109 aa, Artificial Sequence
  source: /note="Description of Artificial Sequence: Synthetic polypeptide"
EIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 8103 - protein, 109 aa, Artificial Sequence
  source: /note="Description of Artificial Sequence: Synthetic polypeptide"
EIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 8104 - protein, 107 aa, Artificial Sequence
  source: /note="Description of Artificial Sequence: Synthetic polypeptide"
DIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 8105 - protein, 109 aa, Artificial Sequence
  source: /note="Description of Artificial Sequence: Synthetic polypeptide"
EIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 8106 - protein, 109 aa, Artificial Sequence
  source: /note="Description of Artificial Sequence: Synthetic polypeptide"
EIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 8107 - protein, 109 aa, Artificial Sequence
  source: /note="Description of Artificial Sequence: Synthetic polypeptide"
EIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 8108 - protein, 109 aa, Artificial Sequence
  source: /note="Description of Artificial Sequence: Synthetic polypeptide"
EIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 8109 - protein, 109 aa, Artificial Sequence
  source: /note="Description of Artificial Sequence: Synthetic polypeptide"
EIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 8110 - protein, 112 aa, Artificial Sequence
  source: /note="Description of Artificial Sequence: Synthetic polypeptide"
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 8111 - protein, 110 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 8112 - protein, 109 aa, Artificial Sequence
  source: /note="Description of Artificial Sequence: Synthetic polypeptide"
EIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 8113-8154 - skipped (42 entries)

SEQ ID NO: 8155 - protein, 122 aa, Artificial Sequence
  source: /note="Description of Artificial Sequence: Synthetic polypeptide"
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSA

SEQ ID NO: 8156 - protein, 117 aa, Artificial Sequence
  source: /note="Description of Artificial Sequence: Synthetic polypeptide"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 8157 - protein, 117 aa, Artificial Sequence
  source: /note="Description of Artificial Sequence: Synthetic polypeptide"
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSS

SEQ ID NO: 8158 - protein, 117 aa, Artificial Sequence
  source: /note="Description of Artificial Sequence: Synthetic polypeptide"
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSS

SEQ ID NO: 8159 - protein, 107 aa, Artificial Sequence
  source: /note="Description of Artificial Sequence: Synthetic polypeptide"
DVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 8160 - protein, 111 aa, Artificial Sequence
  source: /note="Description of Artificial Sequence: Synthetic polypeptide"
DIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIK

SEQ ID NO: 8161 - protein, 111 aa, Artificial Sequence
  source: /note="Description of Artificial Sequence: Synthetic polypeptide"
DIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 8162 - protein, 111 aa, Artificial Sequence; identical to SEQ ID NO: 8161
  source: /note="Description of Artificial Sequence: Synthetic polypeptide"

SEQ ID NO: 8163 - protein, 244 aa, Artificial Sequence
  source: /note="Description of Artificial Sequence: Synthetic polypeptide"
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 8164 - protein, 249 aa, Artificial Sequence
  source: /note="Description of Artificial Sequence: Synthetic polypeptide"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 8165 - protein, 243 aa, Artificial Sequence
  source: /note="Description of Artificial Sequence: Synthetic polypeptide"
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 8166 - protein, 243 aa, Artificial Sequence
  source: /note="Description of Artificial Sequence: Synthetic polypeptide"
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 8167 - protein, 18 aa, Artificial Sequence
  source: /note="Description of Artificial Sequence: Synthetic peptide"
GSTSGSGKPGSGEGSTKG

SEQ ID NO: 8168-8283 - skipped (116 entries)

SEQ ID NO: 8284 - protein, 5 aa, Artificial Sequence
  source: /note="Description of Artificial Sequence: Synthetic peptide"
NYAMS

SEQ ID NO: 8285 - protein, 5 aa, Artificial Sequence
  source: /note="Description of Artificial Sequence: Synthetic peptide"
DYAMH

SEQ ID NO: 8286 - protein, 5 aa, Artificial Sequence
  source: /note="Description of Artificial Sequence: Synthetic peptide"
NHGMS

SEQ ID NO: 8287 - protein, 5 aa, Artificial Sequence
  source: /note="Description of Artificial Sequence: Synthetic peptide"
NFGIN

SEQ ID NO: 8288 - protein, 5 aa, Artificial Sequence
  source: /note="Description of Artificial Sequence: Synthetic peptide"
SDAMT

SEQ ID NO: 8289 - protein, 5 aa, Artificial Sequence
  source: /note="Description of Artificial Sequence: Synthetic peptide"
NYGIT

SEQ ID NO: 8290 - protein, 5 aa, Artificial Sequence
  source: /note="Description of Artificial Sequence: Synthetic peptide"
NHGMS

SEQ ID NO: 8291 - protein, 5 aa, Artificial Sequence
  source: /note="Description of Artificial Sequence: Synthetic peptide"
NHGMS

SEQ ID NO: 8292 - protein, 5 aa, Artificial Sequence
  source: /note="Description of Artificial Sequence: Synthetic peptide"
NHGMS

SEQ ID NO: 8293 - protein, 5 aa, Artificial Sequence
  source: /note="Description of Artificial Sequence: Synthetic peptide"
DYYMS

SEQ ID NO: 8294 - protein, 5 aa, Artificial Sequence
  source: /note="Description of Artificial Sequence: Synthetic peptide"
NHGMS

SEQ ID NO: 8295 - protein, 5 aa, Artificial Sequence
  source: /note="Description of Artificial Sequence: Synthetic peptide"
DYYMS

SEQ ID NO: 8296 - protein, 5 aa, Artificial Sequence
  source: /note="Description of Artificial Sequence: Synthetic peptide"
NHGMS

SEQ ID NO: 8297 - protein, 5 aa, Artificial Sequence
  source: /note="Description of Artificial Sequence: Synthetic peptide"
NHGMS

SEQ ID NO: 8298 - protein, 5 aa, Artificial Sequence
  source: /note="Description of Artificial Sequence: Synthetic peptide"
NHGMS

SEQ ID NO: 8299 - protein, 7 aa, Artificial Sequence
  source: /note="Description of Artificial Sequence: Synthetic peptide"
SSYYYWG

SEQ ID NO: 8300 - protein, 7 aa, Artificial Sequence
  source: /note="Description of Artificial Sequence: Synthetic peptide"
TSGMCVS

SEQ ID NO: 8301 - protein, 5 aa, Artificial Sequence
  source: /note="Description of Artificial Sequence: Synthetic peptide"
SYSMN

SEQ ID NO: 8302 - protein, 5 aa, Artificial Sequence
  source: /note="Description of Artificial Sequence: Synthetic peptide"
DYYMS

SEQ ID NO: 8303 - protein, 5 aa, Artificial Sequence
  source: /note="Description of Artificial Sequence: Synthetic peptide"
SHYIH

SEQ ID NO: 8304 - protein, 7 aa, Artificial Sequence
  source: /note="Description of Artificial Sequence: Synthetic peptide"
SGGYYWS

SEQ ID NO: 8305 - protein, 5 aa, Artificial Sequence
  source: /note="Description of Artificial Sequence: Synthetic peptide"
SYAIS

SEQ ID NO: 8306 - protein, 7 aa, Artificial Sequence
  source: /note="Description of Artificial Sequence: Synthetic peptide"
SNSAAWN

SEQ ID NO: 8307 - protein, 5 aa, Artificial Sequence
  source: /note="Description of Artificial Sequence: Synthetic peptide"
SYAMS

SEQ ID NO: 8308 - protein, 5 aa, Artificial Sequence
  source: /note="Description of Artificial Sequence: Synthetic peptide"
RYPMS

SEQ ID NO: 8309 - protein, 5 aa, Artificial Sequence
  source: /note="Description of Artificial Sequence: Synthetic peptide"
SYAMS

SEQ ID NO: 8310 - protein, 5 aa, Artificial Sequence
  source: /note="Description of Artificial Sequence: Synthetic peptide"
SYAMS

SEQ ID NO: 8311 - protein, 5 aa, Artificial Sequence
  source: /note="Description of Artificial Sequence: Synthetic peptide"
DYAMH

SEQ ID NO: 8312 - protein, 5 aa, Artificial Sequence
  source: /note="Description of Artificial Sequence: Synthetic peptide"
DYAMH

SEQ ID NO: 8313 - protein, 5 aa, Artificial Sequence
  source: /note="Description of Artificial Sequence: Synthetic peptide"
SYAMS

SEQ ID NO: 8314 - protein, 5 aa, Artificial Sequence
  source: /note="Description of Artificial Sequence: Synthetic peptide"
SYAMS

SEQ ID NO: 8315 - protein, 5 aa, Artificial Sequence
  source: /note="Description of Artificial Sequence: Synthetic peptide"
SYAMS

SEQ ID NO: 8316 - protein, 5 aa, Artificial Sequence
  source: /note="Description of Artificial Sequence: Synthetic peptide"
SYAMS

SEQ ID NO: 8317 - protein, 5 aa, Artificial Sequence
  source: /note="Description of Artificial Sequence: Synthetic peptide"
SYAMS

SEQ ID NO: 8318 - protein, 5 aa, Artificial Sequence
  source: /note="Description of Artificial Sequence: Synthetic peptide"
SYAMS

SEQ ID NO: 8319 - protein, 5 aa, Artificial Sequence
  source: /note="Description of Artificial Sequence: Synthetic peptide"
SYAMS

SEQ ID NO: 8320 - protein, 5 aa, Artificial Sequence
  source: /note="Description of Artificial Sequence: Synthetic peptide"
NFGMN

SEQ ID NO: 8321 - protein, 5 aa, Artificial Sequence
  source: /note="Description of Artificial Sequence: Synthetic peptide"
DYSIN

SEQ ID NO: 8322 - protein, 5 aa, Artificial Sequence
  source: /note="Description of Artificial Sequence: Synthetic peptide"
HYSMN

SEQ ID NO: 8323 - protein, 5 aa, Artificial Sequence
  source: /note="Description of Artificial Sequence: Synthetic peptide"
HYSMN

SEQ ID NO: 8324 - protein, 17 aa, Artificial Sequence
  source: /note="Description of Artificial Sequence: Synthetic peptide"
GISRSGENTYYADSVKG

SEQ ID NO: 8325 - protein, 17 aa, Artificial Sequence
  source: /note="Description of Artificial Sequence: Synthetic peptide"
GISWNSGSIGYADSVKG

SEQ ID NO: 8326 - protein, 16 aa, Artificial Sequence
  source: /note="Description of Artificial Sequence: Synthetic peptide"
GIVYSGSTYYAASVKG

SEQ ID NO: 8327 - protein, 17 aa, Artificial Sequence
  source: /note="Description of Artificial Sequence: Synthetic peptide"
WINPKNNNTNYAQKFQG

SEQ ID NO: 8328 - protein, 17 aa, Artificial Sequence
  source: /note="Description of Artificial Sequence: Synthetic peptide"
VISGSGGTTYYADSVKG

SEQ ID NO: 8329 - protein, 17 aa, Artificial Sequence
  source: /note="Description of Artificial Sequence: Synthetic peptide"
WISAYNGNTNYAQKFQG

SEQ ID NO: 8330 - protein, 16 aa, Artificial Sequence
  source: /note="Description of Artificial Sequence: Synthetic peptide"
GIVYSGSTYYAASVKG

SEQ ID NO: 8331 - protein, 16 aa, Artificial Sequence
  source: /note="Description of Artificial Sequence: Synthetic peptide"
GIVYSGSTYYAASVKG

SEQ ID NO: 8332 - protein, 16 aa, Artificial Sequence
  source: /note="Description of Artificial Sequence: Synthetic peptide"
GIVYSGSTYYAASVKG

SEQ ID NO: 8333 - protein, 17 aa, Artificial Sequence
  source: /note="Description of Artificial Sequence: Synthetic peptide"
YISSSGSTIYYADSVKG

SEQ ID NO: 8334 - protein, 16 aa, Artificial Sequence
  source: /note="Description of Artificial Sequence: Synthetic peptide"
GIVYSGSTYYAASVKG

SEQ ID NO: 8335 - protein, 17 aa, Artificial Sequence
  source: /note="Description of Artificial Sequence: Synthetic peptide"
YISSSGNTIYYADSVKG

SEQ ID NO: 8336 - protein, 16 aa, Artificial Sequence
  source: /note="Description of Artificial Sequence: Synthetic peptide"
GIVYSGSTYYAASVKG

SEQ ID NO: 8337 - protein, 16 aa, Artificial Sequence
  source: /note="Description of Artificial Sequence: Synthetic peptide"
GIVYSGSTYYAASVKG

SEQ ID NO: 8338 - protein, 16 aa, Artificial Sequence
  source: /note="Description of Artificial Sequence: Synthetic peptide"
GIVYSGSTYYAASVKG

SEQ ID NO: 8339 - protein, 16 aa, Artificial Sequence
  source: /note="Description of Artificial Sequence: Synthetic peptide"
SIYYSGSAYYNPSLKS

SEQ ID NO: 8340 - protein, 16 aa, Artificial Sequence
  source: /note="Description of Artificial Sequence: Synthetic peptide"
RIDWDEDKFYSTSLKT

SEQ ID NO: 8341 - protein, 17 aa, Artificial Sequence
  source: /note="Description of Artificial Sequence: Synthetic peptide"
SISSSSSYIYYADSVKG

SEQ ID NO: 8342 - protein, 17 aa, Artificial Sequence
  source: /note="Description of Artificial Sequence: Synthetic peptide"
YISSSGSTIYYADSVKG

SEQ ID NO: 8343 - protein, 17 aa, Artificial Sequence
  source: /note="Description of Artificial Sequence: Synthetic peptide"
MINPSGGVTAYSQTLQG

SEQ ID NO: 8344 - protein, 16 aa, Artificial Sequence
  source: /note="Description of Artificial Sequence: Synthetic peptide"
YIYYSGSTYYNPSLKS

SEQ ID NO: 8345 - protein, 17 aa, Artificial Sequence
  source: /note="Description of Artificial Sequence: Synthetic peptide"
GIIPIFGTANYAQKFQG

SEQ ID NO: 8346 - protein, 18 aa, Artificial Sequence
  source: /note="Description of Artificial Sequence: Synthetic peptide"
RTYYRSKWYSFYAISLKS

SEQ ID NO: 8347 - protein, 17 aa, Artificial Sequence
  source: /note="Description of Artificial Sequence: Synthetic peptide"
AISGSGGSTYYADSVKG

SEQ ID NO: 8348 - protein, 17 aa, Artificial Sequence
  source: /note="Description of Artificial Sequence: Synthetic peptide"
GISDSGVSTYYADSAKG

SEQ ID NO: 8349 - protein, 17 aa, Artificial Sequence
  source: /note="Description of Artificial Sequence: Synthetic peptide"
AISGSGGSTYYADSVKG

SEQ ID NO: 8350 - protein, 17 aa, Artificial Sequence
  source: /note="Description of Artificial Sequence: Synthetic peptide"
AISGSGGSTYYADSVKG

SEQ ID NO: 8351 - protein, 17 aa, Artificial Sequence
  source: /note="Description of Artificial Sequence: Synthetic peptide"
GISWNSGSIGYADSVKG

SEQ ID NO: 8352 - protein, 17 aa, Artificial Sequence
  source: /note="Description of Artificial Sequence: Synthetic peptide"
SINWKGNSLAYGDSVKG

SEQ ID NO: 8353 - protein, 17 aa, Artificial Sequence
  source: /note="Description of Artificial Sequence: Synthetic peptide"
AISGSGGSTYYADSVKG

SEQ ID NO: 8354 - protein, 17 aa, Artificial Sequence
  source: /note="Description of Artificial Sequence: Synthetic peptide"
AISGSGGSTYYADSVKG

SEQ ID NO: 8355 - protein, 17 aa, Artificial Sequence
  source: /note="Description of Artificial Sequence: Synthetic peptide"
AISGSGGSTYYADSVKG

SEQ ID NO: 8356 - protein, 17 aa, Artificial Sequence
  source: /note="Description of Artificial Sequence: Synthetic peptide"
AISGSGGSTYYADSVKG

SEQ ID NO: 8357 - protein, 17 aa, Artificial Sequence
  source: /note="Description of Artificial Sequence: Synthetic peptide"
AISGSGGSTYYADSVKG

SEQ ID NO: 8358 - protein, 17 aa, Artificial Sequence
  source: /note="Description of Artificial Sequence: Synthetic peptide"
AISGSGGSTYYADSVKG

SEQ ID NO: 8359 - protein, 17 aa, Artificial Sequence
  source: /note="Description of Artificial Sequence: Synthetic peptide"
AISGSGGSTYYADSVKG

SEQ ID NO: 8360 - protein, 17 aa, Artificial Sequence
  source: /note="Description of Artificial Sequence: Synthetic peptide"
WINTYTGESYFADDFKG

SEQ ID NO: 8361 - protein, 17 aa, Artificial Sequence
  source: /note="Description of Artificial Sequence: Synthetic peptide"
WINTETREPAYAYDFRG

SEQ ID NO: 8362 - protein, 17 aa, Artificial Sequence
  source: /note="Description of Artificial Sequence: Synthetic peptide"
RINTESGVPIYADDFKG

SEQ ID NO: 8363 - protein, 17 aa, Artificial Sequence
  source: /note="Description of Artificial Sequence: Synthetic peptide"
RINTETGEPLYADDFKG

SEQ ID NO: 8364 - protein, 11 aa, Artificial Sequence
  source: /note="Description of Artificial Sequence: Synthetic peptide"
SPAHYYGGMDV

SEQ ID NO: 8365 - protein, 6 aa, Artificial Sequence
  source: /note="Description of Artificial Sequence: Synthetic peptide"
HSFLAY

SEQ ID NO: 8366 - protein, 7 aa, Artificial Sequence
  source: /note="Description of Artificial Sequence: Synthetic peptide"
HGGESDV

SEQ ID NO: 8367 - protein, 11 aa, Artificial Sequence
  source: /note="Description of Artificial Sequence: Synthetic peptide"
GPYYYQSYMDV

SEQ ID NO: 8368 - protein, 14 aa, Artificial Sequence
  source: /note="Description of Artificial Sequence: Synthetic peptide"
LDSSGYYYARGPRY

SEQ ID NO: 8369 - protein, 9 aa, Artificial Sequence
  source: /note="Description of Artificial Sequence: Synthetic peptide"
GPYYYYMDV

SEQ ID NO: 8370 - protein, 7 aa, Artificial Sequence
  source: /note="Description of Artificial Sequence: Synthetic peptide"
HGGESDV

SEQ ID NO: 8371 - protein, 7 aa, Artificial Sequence
  source: /note="Description of Artificial Sequence: Synthetic peptide"
HGGESDV

SEQ ID NO: 8372 - protein, 7 aa, Artificial Sequence
  source: /note="Description of Artificial Sequence: Synthetic peptide"
HGGESDV

SEQ ID NO: 8373 - protein, 8 aa, Artificial Sequence
  source: /note="Description of Artificial Sequence: Synthetic peptide"
ESGDGMDV

SEQ ID NO: 8374 - protein, 7 aa, Artificial Sequence
  source: /note="Description of Artificial Sequence: Synthetic peptide"
HGGESDV

SEQ ID NO: 8375 - protein, 8 aa, Artificial Sequence
  source: /note="Description of Artificial Sequence: Synthetic peptide"
STMVREDY

SEQ ID NO: 8376 - protein, 7 aa, Artificial Sequence
  source: /note="Description of Artificial Sequence: Synthetic peptide"
HGGESDV

SEQ ID NO: 8377 - protein, 7 aa, Artificial Sequence
  source: /note="Description of Artificial Sequence: Synthetic peptide"
HGGESDV

SEQ ID NO: 8378 - protein, 7 aa, Artificial Sequence
  source: /note="Description of Artificial Sequence: Synthetic peptide"
HGGESDV

SEQ ID NO: 8379 - protein, 11 aa, Artificial Sequence
  source: /note="Description of Artificial Sequence: Synthetic peptide"
HWQEWPDAFDI

SEQ ID NO: 8380 - protein, 13 aa, Artificial Sequence
  source: /note="Description of Artificial Sequence: Synthetic peptide"
SGAGGTSATAFDI

SEQ ID NO: 8381 - protein, 10 aa, Artificial Sequence
  source: /note="Description of Artificial Sequence: Synthetic peptide"
TIAAVYAFDI

SEQ ID NO: 8382 - protein, 8 aa, Artificial Sequence
  source: /note="Description of Artificial Sequence: Synthetic peptide"
DLRGAFDI

SEQ ID NO: 8383 - protein, 11 aa, Artificial Sequence
  source: /note="Description of Artificial Sequence: Synthetic peptide"
EGSGSGWYFDF

SEQ ID NO: 8384 - protein, 13 aa, Artificial Sequence
  source: /note="Description of Artificial Sequence: Synthetic peptide"
AGIAARLRGAFDI

SEQ ID NO: 8385 - protein, 20 aa, Artificial Sequence
  source: /note="Description of Artificial Sequence: Synthetic peptide"
RGGYQLLRWDVGLLRSAFDI

SEQ ID NO: 8386 - protein, 13 aa, Artificial Sequence
  source: /note="Description of Artificial Sequence: Synthetic peptide"
SSPEGLFLYWFDP

SEQ ID NO: 8387 - protein, 9 aa, Artificial Sequence
  source: /note="Description of Artificial Sequence: Synthetic peptide"
VEGSGSLDY

SEQ ID NO: 8388 - protein, 9 aa, Artificial Sequence
  source: /note="Description of Artificial Sequence: Synthetic peptide"
RAGSEASDI

SEQ ID NO: 8389 - protein, 15 aa, Artificial Sequence
  source: /note="Description of Artificial Sequence: Synthetic peptide"
ATYKRELRYYYGMDV

SEQ ID NO: 8390 - protein, 15 aa, Artificial Sequence
  source: /note="Description of Artificial Sequence: Synthetic peptide"
ATYKRELRYYYGMDV

SEQ ID NO: 8391 - protein, 8 aa, Artificial Sequence
  source: /note="Description of Artificial Sequence: Synthetic peptide"
VGKAVPDV

SEQ ID NO: 8392 - protein, 13 aa, Artificial Sequence
  source: /note="Description of Artificial Sequence: Synthetic peptide"
HQGVAYYNYAMDV

SEQ ID NO: 8393 - protein, 8 aa, Artificial Sequence
  source: /note="Description of Artificial Sequence: Synthetic peptide"
VVRDGMDV

SEQ ID NO: 8394 - protein, 9 aa, Artificial Sequence
  source: /note="Description of Artificial Sequence: Synthetic peptide"
IPQTGTFDY

SEQ ID NO: 8395 - protein, 15 aa, Artificial Sequence
  source: /note="Description of Artificial Sequence: Synthetic peptide"
ANYKRELRYYYGMDV

SEQ ID NO: 8396 - protein, 11 aa, Artificial Sequence
  source: /note="Description of Artificial Sequence: Synthetic peptide"
ALVGATGAFDI

SEQ ID NO: 8397 - protein, 8 aa, Artificial Sequence
  source: /note="Description of Artificial Sequence: Synthetic peptide"
WFGEGFDP

SEQ ID NO: 8398 - protein, 17 aa, Artificial Sequence
  source: /note="Description of Artificial Sequence: Synthetic peptide"
VGYDSSGYYRDYYGMDV

SEQ ID NO: 8399 - protein, 13 aa, Artificial Sequence
  source: /note="Description of Artificial Sequence: Synthetic peptide"
MGWSSGYLGAFDI

SEQ ID NO: 8400 - protein, 13 aa, Artificial Sequence
  source: /note="Description of Artificial Sequence: Synthetic peptide"
GEIYYGYDGGFAY

SEQ ID NO: 8401 - protein, 8 aa, Artificial Sequence
  source: /note="Description of Artificial Sequence: Synthetic peptide"
DYSYAMDY

SEQ ID NO: 8402 - protein, 8 aa, Artificial Sequence
  source: /note="Description of Artificial Sequence: Synthetic peptide"
DYLYSLDF

SEQ ID NO: 8403 - protein, 8 aa, Artificial Sequence
  source: /note="Description of Artificial Sequence: Synthetic peptide"
DYLYSCDY

SEQ ID NO: 8404 - protein, 12 aa, Artificial Sequence
  source: /note="Description of Artificial Sequence: Synthetic peptide"
RASQSISSSFLA

SEQ ID NO: 8405 - protein, 16 aa, Artificial Sequence
  source: /note="Description of Artificial Sequence: Synthetic peptide"
RSSQSLLHSNGYNYLD

SEQ ID NO: 8406 - protein, 16 aa, Artificial Sequence
  source: /note="Description of Artificial Sequence: Synthetic peptide"
KSSQSLLRNDGKTPLY

SEQ ID NO: 8407 - protein, 16 aa, Artificial Sequence
  source: /note="Description of Artificial Sequence: Synthetic peptide"
RSSQSLLHSNGYNYLN

SEQ ID NO: 8408 - protein, 11 aa, Artificial Sequence
  source: /note="Description of Artificial Sequence: Synthetic peptide"
RASQSISSYLN

SEQ ID NO: 8409 - protein, 16 aa, Artificial Sequence
  source: /note="Description of Artificial Sequence: Synthetic peptide"
RSSQSLLYSNGYNYVD

SEQ ID NO: 8410 - protein, 11 aa, Artificial Sequence
  source: /note="Description of Artificial Sequence: Synthetic peptide"
RASQSVSSNLA

SEQ ID NO: 8411 - protein, 11 aa, Artificial Sequence
  source: /note="Description of Artificial Sequence: Synthetic peptide"
RASQSVSSKLA

SEQ ID NO: 8412 - protein, 12 aa, Artificial Sequence
  source: /note="Description of Artificial Sequence: Synthetic peptide"
RASQSVGSTNLA

SEQ ID NO: 8413 - protein, 11 aa, Artificial Sequence
  source: /note="Description of Artificial Sequence: Synthetic peptide"
RASQSISSYLN

SEQ ID NO: 8414 - protein, 11 aa, Artificial Sequence
  source: /note="Description of Artificial Sequence: Synthetic peptide"
RASQSISSYLN

SEQ ID NO: 8415 - protein, 16 aa, Artificial Sequence
  source: /note="Description of Artificial Sequence: Synthetic peptide"
KSSESLVHNSGKTYLN

SEQ ID NO: 8416 - protein, 11 aa, Artificial Sequence
  source: /note="Description of Artificial Sequence: Synthetic peptide"
QASEDINKFLN

SEQ ID NO: 8417 - protein, 11 aa, Artificial Sequence
  source: /note="Description of Artificial Sequence: Synthetic peptide"
RASQSVGSNLA

SEQ ID NO: 8418 - protein, 12 aa, Artificial Sequence
  source: /note="Description of Artificial Sequence: Synthetic peptide"
RASQSIGSSSLA

SEQ ID NO: 8419 - protein, 11 aa, Artificial Sequence
  source: /note="Description of Artificial Sequence: Synthetic peptide"
KASQDIDDAMN

SEQ ID NO: 8420 - protein, 11 aa, Artificial Sequence
  source: /note="Description of Artificial Sequence: Synthetic peptide"
RASQDIYNNLA

SEQ ID NO: 8421 - protein, 16 aa, Artificial Sequence
  source: /note="Description of Artificial Sequence: Synthetic peptide"
RSSQSLLHSNGYNYLD

SEQ ID NO: 8422 - protein, 11 aa, Artificial Sequence
  source: /note="Description of Artificial Sequence: Synthetic peptide"
GGNNIGTKSVH

SEQ ID NO: 8423 - protein, 11 aa, Artificial Sequence
  source: /note="Description of Artificial Sequence: Synthetic peptide"
SGDGLSKKYVS

SEQ ID NO: 8424 - protein, 11 aa, Artificial Sequence
  source: /note="Description of Artificial Sequence: Synthetic peptide"
RASQGIRNWLA

SEQ ID NO: 8425 - protein, 11 aa, Artificial Sequence
  source: /note="Description of Artificial Sequence: Synthetic peptide"
GGNNIGSKSVH

SEQ ID NO: 8426 - protein, 11 aa, Artificial Sequence
  source: /note="Description of Artificial Sequence: Synthetic peptide"
QGDSLGNYYAT

SEQ ID NO: 8427 - protein, 12 aa, Artificial Sequence
  source: /note="Description of Artificial Sequence: Synthetic peptide"
RASQSVSSAYLA

SEQ ID NO: 8428 - protein, 11 aa, Artificial Sequence
  source: /note="Description of Artificial Sequence: Synthetic peptide"
RASQSVSNSLA

SEQ ID NO: 8429 - protein, 12 aa, Artificial Sequence
  source: /note="Description of Artificial Sequence: Synthetic peptide"
RASQSVSSSFLA

SEQ ID NO: 8430 - protein, 12 aa, Artificial Sequence
  source: /note="Description of Artificial Sequence: Synthetic peptide"
RASQSVSTTFLA

SEQ ID NO: 8431 - protein, 11 aa, Artificial Sequence
  source: /note="Description of Artificial Sequence: Synthetic peptide"
RASQSISSYLN

SEQ ID NO: 8432 - protein, 12 aa, Artificial Sequence
  source: /note="Description of Artificial Sequence: Synthetic peptide"
RATQSIGSSFLA

SEQ ID NO: 8433 - protein, 12 aa, Artificial Sequence
  source: /note="Description of Artificial Sequence: Synthetic peptide"
RASQSVSSSYLA

SEQ ID NO: 8434 - protein, 12 aa, Artificial Sequence
  source: /note="Description of Artificial Sequence: Synthetic peptide"
RASQSVSSSYLA

SEQ ID NO: 8435 - protein, 12 aa, Artificial Sequence
  source: /note="Description of Artificial Sequence: Synthetic peptide"
RASQRVASNYLA

SEQ ID NO: 8436 - protein, 12 aa, Artificial Sequence
  source: /note="Description of Artificial Sequence: Synthetic peptide"
RASQSLSSNFLA

SEQ ID NO: 8437 - protein, 16 aa, Artificial Sequence
  source: /note="Description of Artificial Sequence: Synthetic peptide"
RSSQSLLHSNGYNYLD

SEQ ID NO: 8438 - protein, 12 aa, Artificial Sequence
  source: /note="Description of Artificial Sequence: Synthetic peptide"
RASQSVSSSYLA

SEQ ID NO: 8439 - protein, 12 aa, Artificial Sequence
  source: /note="Description of Artificial Sequence: Synthetic peptide"
RASQSVASSFLA

SEQ ID NO: 8440 - protein, 11 aa, Artificial Sequence
  source: /note="Description of Artificial Sequence: Synthetic peptide"
RASQDVNTAVS

SEQ ID NO: 8441 - protein, 15 aa, Artificial Sequence
  source: /note="Description of Artificial Sequence: Synthetic peptide"
RASESVSVIGAHLIH

SEQ ID NO: 8442 - protein, 15 aa, Artificial Sequence
  source: /note="Description of Artificial Sequence: Synthetic peptide"
RASESVTILGSHLIY

SEQ ID NO: 8443 - protein, 15 aa, Artificial Sequence
  source: /note="Description of Artificial Sequence: Synthetic peptide"
RASESVTILGSHLIY

SEQ ID NO: 8444 - protein, 7 aa, Artificial Sequence
  source: /note="Description of Artificial Sequence: Synthetic peptide"
GASRRAT

SEQ ID NO: 8445 - protein, 7 aa, Artificial Sequence
  source: /note="Description of Artificial Sequence: Synthetic peptide"
LGSNRAS

SEQ ID NO: 8446 - protein, 7 aa, Artificial Sequence
  source: /note="Description of Artificial Sequence: Synthetic peptide"
EVSNRFS

SEQ ID NO: 8447 - protein, 7 aa, Artificial Sequence
  source: /note="Description of Artificial Sequence: Synthetic peptide"
LGSKRAS

SEQ ID NO: 8448 - protein, 7 aa, Artificial Sequence
  source: /note="Description of Artificial Sequence: Synthetic peptide"
GASTLAS

SEQ ID NO: 8449 - protein, 7 aa, Artificial Sequence
  source: /note="Description of Artificial Sequence: Synthetic peptide"
LGSNRAS

SEQ ID NO: 8450 - protein, 7 aa, Artificial Sequence
  source: /note="Description of Artificial Sequence: Synthetic peptide"
GASTRAS

SEQ ID NO: 8451 - protein, 7 aa, Artificial Sequence
  source: /note="Description of Artificial Sequence: Synthetic peptide"
GASIRAT

SEQ ID NO: 8452 - protein, 7 aa, Artificial Sequence
  source: /note="Description of Artificial Sequence: Synthetic peptide"
DASNRAT

SEQ ID NO: 8453 - protein, 7 aa, Artificial Sequence
  source: /note="Description of Artificial Sequence: Synthetic peptide"
AASSLQS

SEQ ID NO: 8454 - protein, 7 aa, Artificial Sequence
  source: /note="Description of Artificial Sequence: Synthetic peptide"
AASSLQS

SEQ ID NO: 8455 - protein, 7 aa, Artificial Sequence
  source: /note="Description of Artificial Sequence: Synthetic peptide"
EVSNRDS

SEQ ID NO: 8456 - protein, 7 aa, Artificial Sequence
  source: /note="Description of Artificial Sequence: Synthetic peptide"
DASTLQT

SEQ ID NO: 8457 - protein, 7 aa, Artificial Sequence
  source: /note="Description of Artificial Sequence: Synthetic peptide"
GASTRAT

SEQ ID NO: 8458 - protein, 7 aa, Artificial Sequence
  source: /note="Description of Artificial Sequence: Synthetic peptide"
GASSRAS

SEQ ID NO: 8459 - protein, 7 aa, Artificial Sequence
  source: /note="Description of Artificial Sequence: Synthetic peptide"
SATSPVP

SEQ ID NO: 8460 - protein, 7 aa, Artificial Sequence
  source: /note="Description of Artificial Sequence: Synthetic peptide"
AANKSQS

SEQ ID NO: 8461 - protein, 7 aa, Artificial Sequence
  source: /note="Description of Artificial Sequence: Synthetic peptide"
LGSNRAS

SEQ ID NO: 8462 - protein, 7 aa, Artificial Sequence
  source: /note="Description of Artificial Sequence: Synthetic peptide"
DDSVRPS

SEQ ID NO: 8463 - protein, 7 aa, Artificial Sequence
  source: /note="Description of Artificial Sequence: Synthetic peptide"
RDKERPS

SEQ ID NO: 8464 - protein, 7 aa, Artificial Sequence
  source: /note="Description of Artificial Sequence: Synthetic peptide"
AASNLQS

SEQ ID NO: 8465 - protein, 7 aa, Artificial Sequence
  source: /note="Description of Artificial Sequence: Synthetic peptide"
GKNNRPS

SEQ ID NO: 8466 - protein, 7 aa, Artificial Sequence
  source: /note="Description of Artificial Sequence: Synthetic peptide"
GTNNRPS

SEQ ID NO: 8467 - protein, 7 aa, Artificial Sequence
  source: /note="Description of Artificial Sequence: Synthetic peptide"
GASTRAT

SEQ ID NO: 8468 - protein, 7 aa, Artificial Sequence
  source: /note="Description of Artificial Sequence: Synthetic peptide"
DASSRAT

SEQ ID NO: 8469 - protein, 7 aa, Artificial Sequence
  source: /note="Description of Artificial Sequence: Synthetic peptide"
GASSRAT

SEQ ID NO: 8470 - protein, 7 aa, Artificial Sequence
  source: /note="Description of Artificial Sequence: Synthetic peptide"
GSSNRAT

SEQ ID NO: 8471 - protein, 7 aa, Artificial Sequence
  source: /note="Description of Artificial Sequence: Synthetic peptide"
AASSLQS

SEQ ID NO: 8472 - protein, 7 aa, Artificial Sequence
  source: /note="Description of Artificial Sequence: Synthetic peptide"
GASQRAT

SEQ ID NO: 8473 - protein, 7 aa, Artificial Sequence
  source: /note="Description of Artificial Sequence: Synthetic peptide"
GASSRAT

SEQ ID NO: 8474 - protein, 7 aa, Artificial Sequence
  source: /note="Description of Artificial Sequence: Synthetic peptide"
GASSRAT

SEQ ID NO: 8475 - protein, 7 aa, Artificial Sequence
  source: /note="Description of Artificial Sequence: Synthetic peptide"
GASSRAT

SEQ ID NO: 8476 - protein, 7 aa, Artificial Sequence
  source: /note="Description of Artificial Sequence: Synthetic peptide"
GASNWAT

SEQ ID NO: 8477 - protein, 7 aa, Artificial Sequence
  source: /note="Description of Artificial Sequence: Synthetic peptide"
LGSNRAS

SEQ ID NO: 8478 - protein, 7 aa, Artificial Sequence
  source: /note="Description of Artificial Sequence: Synthetic peptide"
GTSSRAT

SEQ ID NO: 8479 - protein, 7 aa, Artificial Sequence
  source: /note="Description of Artificial Sequence: Synthetic peptide"
GASGRAT

SEQ ID NO: 8480 - protein, 7 aa, Artificial Sequence
  source: /note="Description of Artificial Sequence: Synthetic peptide"
SASYRYT

SEQ ID NO: 8481 - protein, 7 aa, Artificial Sequence
  source: /note="Description of Artificial Sequence: Synthetic peptide"
LASNLET

SEQ ID NO: 8482 - protein, 7 aa, Artificial Sequence
  source: /note="Description of Artificial Sequence: Synthetic peptide"
LASNVQT

SEQ ID NO: 8483 - protein, 7 aa, Artificial Sequence
  source: /note="Description of Artificial Sequence: Synthetic peptide"
LASNVQT

SEQ ID NO: 8484 - protein, 10 aa, Artificial Sequence
  source: /note="Description of Artificial Sequence: Synthetic peptide"
QQYHSSPSWT

SEQ ID NO: 8485 - protein, 9 aa, Artificial Sequence
  source: /note="Description of Artificial Sequence: Synthetic peptide"
MQALQTPYT

SEQ ID NO: 8486 - protein, 8 aa, Artificial Sequence
  source: /note="Description of Artificial Sequence: Synthetic peptide"
MQNIQFPS

SEQ ID NO: 8487 - protein, 9 aa, Artificial Sequence
  source: /note="Description of Artificial Sequence: Synthetic peptide"
MQALQTPYT

SEQ ID NO: 8488 - protein, 8 aa, Artificial Sequence
  source: /note="Description of Artificial Sequence: Synthetic peptide"
QQSYKRAS

SEQ ID NO: 8489 - protein, 9 aa, Artificial Sequence
  source: /note="Description of Artificial Sequence: Synthetic peptide"
MQGRQFPYS

SEQ ID NO: 8490 - protein, 8 aa, Artificial Sequence
  source: /note="Description of Artificial Sequence: Synthetic peptide"
QQYGSSLT

SEQ ID NO: 8491 - protein, 9 aa, Artificial Sequence
  source: /note="Description of Artificial Sequence: Synthetic peptide"
QQYGSSSWT

SEQ ID NO: 8492 - protein, 10 aa, Artificial Sequence
  source: /note="Description of Artificial Sequence: Synthetic peptide"
QQYGSSPPWT

SEQ ID NO: 8493 - protein, 7 aa, Artificial Sequence
  source: /note="Description of Artificial Sequence: Synthetic peptide"
QQSYTLA

SEQ ID NO: 8494 - protein, 9 aa, Artificial Sequence
  source: /note="Description of Artificial Sequence: Synthetic peptide"
QQSYSTPYT

SEQ ID NO: 8495 - protein, 9 aa, Artificial Sequence
  source: /note="Description of Artificial Sequence: Synthetic peptide"
MQGTHWPGT

SEQ ID NO: 8496 - protein, 9 aa, Artificial Sequence
  source: /note="Description of Artificial Sequence: Synthetic peptide"
QQYESLPLT

SEQ ID NO: 8497 - protein, 10 aa, Artificial Sequence
  source: /note="Description of Artificial Sequence: Synthetic peptide"
QQYNDWLPVT

SEQ ID NO: 8498 - protein, 10 aa, Artificial Sequence
  source: /note="Description of Artificial Sequence: Synthetic peptide"
QQYAGSPPFT

SEQ ID NO: 8499 - protein, 9 aa, Artificial Sequence
  source: /note="Description of Artificial Sequence: Synthetic peptide"
LQHDNFPLT

SEQ ID NO: 8500 - protein, 9 aa, Artificial Sequence
  source: /note="Description of Artificial Sequence: Synthetic peptide"
QHYYRFPYS

SEQ ID NO: 8501 - protein, 9 aa, Artificial Sequence
  source: /note="Description of Artificial Sequence: Synthetic peptide"
MQALQTPYT

SEQ ID NO: 8502 - protein, 11 aa, Artificial Sequence
  source: /note="Description of Artificial Sequence: Synthetic peptide"
QVWDSDSEHVV

SEQ ID NO: 8503 - protein, 9 aa, Artificial Sequence
  source: /note="Description of Artificial Sequence: Synthetic peptide"
QAWDDTTVV

SEQ ID NO: 8504 - protein, 9 aa, Artificial Sequence
  source: /note="Description of Artificial Sequence: Synthetic peptide"
QKYNSAPFT

SEQ ID NO: 8505 - protein, 12 aa, Artificial Sequence
  source: /note="Description of Artificial Sequence: Synthetic peptide"
SSRDSSGDHLRV

SEQ ID NO: 8506 - protein, 11 aa, Artificial Sequence
  source: /note="Description of Artificial Sequence: Synthetic peptide"
NSRDSSGHHLL

SEQ ID NO: 8507 - protein, 14 aa, Artificial Sequence
  source: /note="Description of Artificial Sequence: Synthetic peptide"
QHYGSSFNGSSLFT

SEQ ID NO: 8508 - protein, 10 aa, Artificial Sequence
  source: /note="Description of Artificial Sequence: Synthetic peptide"
QQFGTSSGLT

SEQ ID NO: 8509 - protein, 10 aa, Artificial Sequence
  source: /note="Description of Artificial Sequence: Synthetic peptide"
QQYHSSPSWT

SEQ ID NO: 8510 - protein, 10 aa, Artificial Sequence
  source: /note="Description of Artificial Sequence: Synthetic peptide"
QQYHSSPSWT

SEQ ID NO: 8511 - protein, 9 aa, Artificial Sequence
  source: /note="Description of Artificial Sequence: Synthetic peptide"
QQSYSTPYS

SEQ ID NO: 8512 - protein, 10 aa, Artificial Sequence
  source: /note="Description of Artificial Sequence: Synthetic peptide"
QHYESSPSWT

SEQ ID NO: 8513 - protein, 10 aa, Artificial Sequence
  source: /note="Description of Artificial Sequence: Synthetic peptide"
QQYGSPPRFT

SEQ ID NO: 8514 - protein, 10 aa, Artificial Sequence
  source: /note="Description of Artificial Sequence: Synthetic peptide"
QHYGSSPSWT

SEQ ID NO: 8515 - protein, 10 aa, Artificial Sequence
  source: /note="Description of Artificial Sequence: Synthetic peptide"
QHYDSSPSWT

SEQ ID NO: 8516 - protein, 10 aa, Artificial Sequence
  source: /note="Description of Artificial Sequence: Synthetic peptide"
QYYGTSPMYT

SEQ ID NO: 8517 - protein, 9 aa, Artificial Sequence
  source: /note="Description of Artificial Sequence: Synthetic peptide"
MQALQTPLT

SEQ ID NO: 8518 - protein, 11 aa, Artificial Sequence
  source: /note="Description of Artificial Sequence: Synthetic peptide"
QHYGNSPPKFT

SEQ ID NO: 8519 - protein, 10 aa, Artificial Sequence
  source: /note="Description of Artificial Sequence: Synthetic peptide"
QHYGGSPRLT

SEQ ID NO: 8520 - protein, 9 aa, Artificial Sequence
  source: /note="Description of Artificial Sequence: Synthetic peptide"
QQHYSTPWT

SEQ ID NO: 8521 - protein, 9 aa, Artificial Sequence
  source: /note="Description of Artificial Sequence: Synthetic peptide"
LQSRIFPRT

SEQ ID NO: 8522 - protein, 9 aa, Artificial Sequence
  source: /note="Description of Artificial Sequence: Synthetic peptide"
LQSRTIPRT

SEQ ID NO: 8523 - protein, 9 aa, Artificial Sequence
  source: /note="Description of Artificial Sequence: Synthetic peptide"
LQSRTIPRT

SEQ ID NO: 8524-8548 - skipped (25 entries)

SEQ ID NO: 8549 - protein, 490 aa, Artificial Sequence
  source: /note="Description of Artificial Sequence: Synthetic polypeptide"
MALPVTALLLPLALLLHAARPQVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8550 - protein, 488 aa, Artificial Sequence
  source: /note="Description of Artificial Sequence: Synthetic polypeptide"
MALPVTALLLPLALLLHAARPQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8551 - protein, 487 aa, Artificial Sequence
  source: /note="Description of Artificial Sequence: Synthetic polypeptide"
MALPVTALLLPLALLLHAARPEVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8552 - protein, 493 aa, Artificial Sequence
  source: /note="Description of Artificial Sequence: Synthetic polypeptide"
MALPVTALLLPLALLLHAARPQVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8553 - protein, 490 aa, Artificial Sequence
  source: /note="Description of Artificial Sequence: Synthetic polypeptide"
MALPVTALLLPLALLLHAARPQVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8554 - protein, 491 aa, Artificial Sequence
  source: /note="Description of Artificial Sequence: Synthetic polypeptide"
MALPVTALLLPLALLLHAARPQVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8555 - protein, 482 aa, Artificial Sequence
  source: /note="Description of Artificial Sequence: Synthetic polypeptide"
MALPVTALLLPLALLLHAARPEVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8556 - protein, 483 aa, Artificial Sequence
  source: /note="Description of Artificial Sequence: Synthetic polypeptide"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8557 - protein, 485 aa, Artificial Sequence
  source: /note="Description of Artificial Sequence: Synthetic polypeptide"
MALPVTALLLPLALLLHAARPEVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8558 - protein, 483 aa, Artificial Sequence
  source: /note="Description of Artificial Sequence: Synthetic polypeptide"
MALPVTALLLPLALLLHAARPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8559 - protein, 483 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8560 - protein, 490 aa, Artificial Sequence
  source: /note="Description of Artificial Sequence: Synthetic polypeptide"
MALPVTALLLPLALLLHAARPQVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8561 - protein, 483 aa, Artificial Sequence
  source: /note="Description of Artificial Sequence: Synthetic polypeptide"
MALPVTALLLPLALLLHAARPQVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8562 - protein, 484 aa, Artificial Sequence
  source: /note="Description of Artificial Sequence: Synthetic polypeptide"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8563 - protein, 485 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8564 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8565 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8566 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8567 - DNA, 1479 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8568 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8569 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggccccaagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8570 - DNA, 1446 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8571 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8572 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8573 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8574 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8575 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8576 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8577 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8578 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8579 - protein, 487 aa, Artificial Sequence
  source: /note="Description of Artificial Sequence: Synthetic polypeptide"
MALPVTALLLPLALLLHAARPQVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8580 - protein, 489 aa, Artificial Sequence
  source: /note="Description of Artificial Sequence: Synthetic polypeptide"
MALPVTALLLPLALLLHAARPQVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8581 - protein, 490 aa, Artificial Sequence
  source: /note="Description of Artificial Sequence: Synthetic polypeptide"
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8582 - protein, 484 aa, Artificial Sequence
  source: /note="Description of Artificial Sequence: Synthetic polypeptide"
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8583 - protein, 485 aa, Artificial Sequence
  source: /note="Description of Artificial Sequence: Synthetic polypeptide"
MALPVTALLLPLALLLHAARPQVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8584 - protein, 489 aa, Artificial Sequence
  source: /note="Description of Artificial Sequence: Synthetic polypeptide"
MALPVTALLLPLALLLHAARPQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8585 - protein, 497 aa, Artificial Sequence
  source: /note="Description of Artificial Sequence: Synthetic polypeptide"
MALPVTALLLPLALLLHAARPQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8586 - protein, 492 aa, Artificial Sequence
  source: /note="Description of Artificial Sequence: Synthetic polypeptide"
MALPVTALLLPLALLLHAARPEVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8587 - protein, 490 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8588 - protein, 485 aa, Artificial Sequence
  source: /note="Description of Artificial Sequence: Synthetic polypeptide"
MALPVTALLLPLALLLHAARPEVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8589 - protein, 492 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8590 - protein, 492 aa, Artificial Sequence
  source: /note="Description of Artificial Sequence: Synthetic polypeptide"
MALPVTALLLPLALLLHAARPEVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8591 - protein, 483 aa, Artificial Sequence
  source: /note="Description of Artificial Sequence: Synthetic polypeptide"
MALPVTALLLPLALLLHAARPEVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8592 - protein, 490 aa, Artificial Sequence
  source: /note="Description of Artificial Sequence: Synthetic polypeptide"
MALPVTALLLPLALLLHAARPEVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8593 - protein, 485 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8594 - protein, 486 aa, Artificial Sequence
  source: /note="Description of Artificial Sequence: Synthetic polypeptide"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8595 - protein, 492 aa, Artificial Sequence
  source: /note="Description of Artificial Sequence: Synthetic polypeptide"
MALPVTALLLPLALLLHAARPEVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8596 - protein, 488 aa, Artificial Sequence
  source: /note="Description of Artificial Sequence: Synthetic polypeptide"
MALPVTALLLPLALLLHAARPEVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8597 - protein, 488 aa, Artificial Sequence
  source: /note="Description of Artificial Sequence: Synthetic polypeptide"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8598 - protein, 495 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8599 - protein, 490 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 8600 - skipped

SEQ ID NO: 8601 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggccccaagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8602 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8603 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8604 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8605 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtccttaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8606 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8607 - DNA, 1491 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8608 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8609 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8610 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8611 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8612 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8613 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8614 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8615 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8616 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8617 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8618 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8619 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8620 - DNA, 1485 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8621 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 8622 - RNA, 20 nt, Homo sapiens
ccccuuaggagucugcacua

SEQ ID NO: 8623 - RNA, 20 nt, Homo sapiens
caaccugucaauccagcuca

SEQ ID NO: 8624 - RNA, 20 nt, Homo sapiens
cacccaugagacccucuccg

SEQ ID NO: 8625 - RNA, 20 nt, Homo sapiens
acccaugagacccucuccgu

SEQ ID NO: 8626 - RNA, 20 nt, Homo sapiens
cccaugagacccucuccgug

SEQ ID NO: 8627 - RNA, 20 nt, Homo sapiens
uagagcaccuaucaugaacg

SEQ ID NO: 8628 - RNA, 20 nt, Homo sapiens
caugaacgaggagaccaagu

SEQ ID NO: 8629 - RNA, 20 nt, Homo sapiens
cuccuaaggggagagaagac

SEQ ID NO: 8630 - RNA, 20 nt, Homo sapiens
ccauagugcagacuccuaag

SEQ ID NO: 8631 - RNA, 20 nt, Homo sapiens
uccauagugcagacuccuaa

SEQ ID NO: 8632 - RNA, 20 nt, Homo sapiens
uuccauagugcagacuccua

SEQ ID NO: 8633 - RNA, 20 nt, Homo sapiens
gugccuugagcuggauugac

SEQ ID NO: 8634 - RNA, 20 nt, Homo sapiens
gggcuaugugugccuugagc

SEQ ID NO: 8635 - RNA, 20 nt, Homo sapiens
agagggucucaugggugucu

SEQ ID NO: 8636 - RNA, 20 nt, Homo sapiens
gagagggucucauggguguc

SEQ ID NO: 8637 - RNA, 20 nt, Homo sapiens
ccccacggagagggucucau

SEQ ID NO: 8638 - RNA, 20 nt, Homo sapiens
uccccacggagagggucuca

SEQ ID NO: 8639 - RNA, 20 nt, Homo sapiens
cucuaggguccccacggaga

SEQ ID NO: 8640 - RNA, 20 nt, Homo sapiens
gcucuaggguccccacggag

SEQ ID NO: 8641 - RNA, 20 nt, Homo sapiens
uaggugcucuagggucccca

SEQ ID NO: 8642 - RNA, 20 nt, Homo sapiens
cguucaugauaggugcucua

SEQ ID NO: 8643 - RNA, 20 nt, Homo sapiens
ucguucaugauaggugcucu

SEQ ID NO: 8644 - RNA, 20 nt, Homo sapiens
uuggucuccucguucaugau

SEQ ID NO: 8645 - RNA, 20 nt, Homo sapiens
ggagagaaaaaucaccuacu

SEQ ID NO: 8646 - RNA, 20 nt, Homo sapiens
cuucccugucccuccagggc

SEQ ID NO: 8647 - RNA, 20 nt, Homo sapiens
ccuccagggcuggcuccuca

SEQ ID NO: 8648 - RNA, 20 nt, Homo sapiens
uggcuccucauggaccccgu

SEQ ID NO: 8649 - RNA, 20 nt, Homo sapiens
gaccccguuggccuccagcu

SEQ ID NO: 8650 - RNA, 20 nt, Homo sapiens
agcucggcaacaagaaccug

SEQ ID NO: 8651 - RNA, 20 nt, Homo sapiens
accuguggagcugucuugug

SEQ ID NO: 8652 - RNA, 20 nt, Homo sapiens
ugcucaccaaagacccagaa

SEQ ID NO: 8653 - RNA, 20 nt, Homo sapiens
gaaguucuuccuccccaaca

SEQ ID NO: 8654 - RNA, 20 nt, Homo sapiens
cuuccuccccaacacggacc

SEQ ID NO: 8655 - RNA, 20 nt, Homo sapiens
ccaacacggaccuggauucc

SEQ ID NO: 8656 - RNA, 20 nt, Homo sapiens
ggauuccaggaacgagaccu

SEQ ID NO: 8657 - RNA, 20 nt, Homo sapiens
acucaacaagcugcaugucc

SEQ ID NO: 8658 - RNA, 20 nt, Homo sapiens
cucaacaagcugcaugucca

SEQ ID NO: 8659 - RNA, 20 nt, Homo sapiens
caagcugcauguccaggguu

SEQ ID NO: 8660 - RNA, 20 nt, Homo sapiens
auguccaggguucggacacc

SEQ ID NO: 8661 - RNA, 20 nt, Homo sapiens
gugcugcugcugaguacuuu

SEQ ID NO: 8662 - RNA, 20 nt, Homo sapiens
aguacuuuuggcuaugauga

SEQ ID NO: 8663 - RNA, 20 nt, Homo sapiens
uuuuggcuaugaugauggua

SEQ ID NO: 8664 - RNA, 20 nt, Homo sapiens
uuuggcuaugaugaugguaa

SEQ ID NO: 8665 - RNA, 20 nt, Homo sapiens
gcuaugaugaugguaagggc

SEQ ID NO: 8666 - RNA, 20 nt, Homo sapiens
gagccagcccuggagggaca

SEQ ID NO: 8667 - RNA, 20 nt, Homo sapiens
ggagccagcccuggagggac

SEQ ID NO: 8668 - RNA, 20 nt, Homo sapiens
caugaggagccagcccugga

SEQ ID NO: 8669 - RNA, 20 nt, Homo sapiens
ccaugaggagccagcccugg

SEQ ID NO: 8670 - RNA, 20 nt, Homo sapiens
gguccaugaggagccagccc

SEQ ID NO: 8671 - RNA, 20 nt, Homo sapiens
ggaggccaacgggguccaug

SEQ ID NO: 8672 - RNA, 20 nt, Homo sapiens
ugccgagcuggaggccaacg

SEQ ID NO: 8673 - RNA, 20 nt, Homo sapiens
uugccgagcuggaggccaac

SEQ ID NO: 8674 - RNA, 20 nt, Homo sapiens
guugccgagcuggaggccaa

SEQ ID NO: 8675 - RNA, 20 nt, Homo sapiens
gguucuuguugccgagcugg

SEQ ID NO: 8676 - RNA, 20 nt, Homo sapiens
acagguucuuguugccgagc

SEQ ID NO: 8677 - RNA, 20 nt, Homo sapiens
gccucacaagacagcuccac

SEQ ID NO: 8678 - RNA, 20 nt, Homo sapiens
guucagccauucugggucuu

SEQ ID NO: 8679 - RNA, 20 nt, Homo sapiens
ucuuggcguucagccauucu

SEQ ID NO: 8680 - RNA, 20 nt, Homo sapiens
aucuuggcguucagccauuc

SEQ ID NO: 8681 - RNA, 20 nt, Homo sapiens
ggggaggaagaacuucaucu

SEQ ID NO: 8682 - RNA, 20 nt, Homo sapiens
aauccagguccguguugggg

SEQ ID NO: 8683 - RNA, 20 nt, Homo sapiens
uggaauccagguccguguug

SEQ ID NO: 8684 - RNA, 20 nt, Homo sapiens
cuggaauccagguccguguu

SEQ ID NO: 8685 - RNA, 20 nt, Homo sapiens
ccuggaauccagguccgugu

SEQ ID NO: 8686 - RNA, 20 nt, Homo sapiens
aggucucguuccuggaaucc

SEQ ID NO: 8687 - RNA, 20 nt, Homo sapiens
aggguccaaggucucguucc

SEQ ID NO: 8688 - RNA, 20 nt, Homo sapiens
gacucucuguucagggucca

SEQ ID NO: 8689 - RNA, 20 nt, Homo sapiens
gcaggaugacucucuguuca

SEQ ID NO: 8690 - RNA, 20 nt, Homo sapiens
ugcaggaugacucucuguuc

SEQ ID NO: 8691 - RNA, 20 nt, Homo sapiens
caugcagcuuguugaguugc

SEQ ID NO: 8692 - RNA, 20 nt, Homo sapiens
acugccagguguccgaaccc

SEQ ID NO: 8693 - RNA, 20 nt, Homo sapiens
acaaugaaugaaagacugcc

SEQ ID NO: 8694 - RNA, 20 nt, Homo sapiens
ugcaggguucaccagccagc

SEQ ID NO: 8695 - RNA, 20 nt, Homo sapiens
gcaggguucaccagccagcu

SEQ ID NO: 8696 - RNA, 20 nt, Homo sapiens
caccagccagcugggagcug

SEQ ID NO: 8697 - RNA, 20 nt, Homo sapiens
accagccagcugggagcuga

SEQ ID NO: 8698 - RNA, 20 nt, Homo sapiens
ccagccagcugggagcugag

SEQ ID NO: 8699 - RNA, 20 nt, Homo sapiens
ccugaaucucagcuccacca

SEQ ID NO: 8700 - RNA, 20 nt, Homo sapiens
aucucagcuccaccauggug

SEQ ID NO: 8701 - RNA, 20 nt, Homo sapiens
agcuccaccauggugaggac

SEQ ID NO: 8702 - RNA, 20 nt, Homo sapiens
accauggugaggacuggagu

SEQ ID NO: 8703 - RNA, 20 nt, Homo sapiens
ccauggugaggacuggaguu

SEQ ID NO: 8704 - RNA, 20 nt, Homo sapiens
cauggugaggacuggaguug

SEQ ID NO: 8705 - RNA, 20 nt, Homo sapiens
auggugaggacuggaguugg

SEQ ID NO: 8706 - RNA, 20 nt, Homo sapiens
uggugaacccugcaagagag

SEQ ID NO: 8707 - RNA, 20 nt, Homo sapiens
cuggugaacccugcaagaga

SEQ ID NO: 8708 - RNA, 20 nt, Homo sapiens
gcuggugaacccugcaagag

SEQ ID NO: 8709 - RNA, 20 nt, Homo sapiens
ccccucagcucccagcuggc

SEQ ID NO: 8710 - RNA, 20 nt, Homo sapiens
uuuuccccucagcucccagc

SEQ ID NO: 8711 - RNA, 20 nt, Homo sapiens
gguggagcugagauucaggu

SEQ ID NO: 8712 - RNA, 20 nt, Homo sapiens
ccaugguggagcugagauuc

SEQ ID NO: 8713 - RNA, 20 nt, Homo sapiens
aacuccaguccucaccaugg

SEQ ID NO: 8714 - RNA, 20 nt, Homo sapiens
cccaacuccaguccucacca

SEQ ID NO: 8715 - RNA, 20 nt, Homo sapiens
aagcgcccacaucagagcug

SEQ ID NO: 8716 - RNA, 20 nt, Homo sapiens
agcgcccacaucagagcugu

SEQ ID NO: 8717 - RNA, 20 nt, Homo sapiens
gcuguggguccucaccccgc

SEQ ID NO: 8718 - RNA, 20 nt, Homo sapiens
cagugcaagaagcagcagcu

SEQ ID NO: 8719 - RNA, 20 nt, Homo sapiens
ugcaagaagcagcagcuagg

SEQ ID NO: 8720 - RNA, 20 nt, Homo sapiens
gcaagaagcagcagcuaggu

SEQ ID NO: 8721 - RNA, 20 nt, Homo sapiens
cagcuagguggguaccagug

SEQ ID NO: 8722 - RNA, 20 nt, Homo sapiens
agcuagguggguaccagugu

SEQ ID NO: 8723 - RNA, 20 nt, Homo sapiens
gcuagguggguaccagugug

SEQ ID NO: 8724 - RNA, 20 nt, Homo sapiens
ggccugaaaaagcaaaggaa

SEQ ID NO: 8725 - RNA, 20 nt, Homo sapiens
aggccugaaaaagcaaagga

SEQ ID NO: 8726 - RNA, 20 nt, Homo sapiens
cuucaggccugaaaaagcaa

SEQ ID NO: 8727 - RNA, 20 nt, Homo sapiens
agcucugaugugggcgcuuc

SEQ ID NO: 8728 - RNA, 20 nt, Homo sapiens
aggacccacagcucugaugu

SEQ ID NO: 8729 - RNA, 20 nt, Homo sapiens
gaggacccacagcucugaug

SEQ ID NO: 8730 - RNA, 20 nt, Homo sapiens
gcacugcuuccggcggggug

SEQ ID NO: 8731 - RNA, 20 nt, Homo sapiens
uucuugcacugcuuccggcg

SEQ ID NO: 8732 - RNA, 20 nt, Homo sapiens
cuucuugcacugcuuccggc

SEQ ID NO: 8733 - RNA, 20 nt, Homo sapiens
gcuucuugcacugcuuccgg

SEQ ID NO: 8734 - RNA, 20 nt, Homo sapiens
gcugcuucuugcacugcuuc

SEQ ID NO: 8735 - RNA, 20 nt, Homo sapiens
gucccugccccuugcagagu

SEQ ID NO: 8736 - RNA, 20 nt, Homo sapiens
agaaguaccugcagcuccug

SEQ ID NO: 8737 - RNA, 20 nt, Homo sapiens
ccucugcccagcagcgcuac

SEQ ID NO: 8738 - RNA, 20 nt, Homo sapiens
cgcuacaggagccaaauccc

SEQ ID NO: 8739 - RNA, 20 nt, Homo sapiens
gcuacaggagccaaaucccu

SEQ ID NO: 8740 - RNA, 20 nt, Homo sapiens
aggagccaaaucccuggguc

SEQ ID NO: 8741 - RNA, 20 nt, Homo sapiens
ggagccaaaucccuggguca

SEQ ID NO: 8742 - RNA, 20 nt, Homo sapiens
gcagccccacgccuuccacc

SEQ ID NO: 8743 - RNA, 20 nt, Homo sapiens
augucccuccaauccugcgc

SEQ ID NO: 8744 - RNA, 20 nt, Homo sapiens
ugucccuccaauccugcgcc

SEQ ID NO: 8745 - RNA, 20 nt, Homo sapiens
cacagcauccuuagacacuc

SEQ ID NO: 8746 - RNA, 20 nt, Homo sapiens
agcauccuuagacacuccgg

SEQ ID NO: 8747 - RNA, 20 nt, Homo sapiens
gcauccuuagacacuccgga

SEQ ID NO: 8748 - RNA, 20 nt, Homo sapiens
cauccuuagacacuccggag

SEQ ID NO: 8749 - RNA, 20 nt, Homo sapiens
auccuuagacacuccggagg

SEQ ID NO: 8750 - RNA, 20 nt, Homo sapiens
cacuccggagggggccauua

SEQ ID NO: 8751 - RNA, 20 nt, Homo sapiens
acuccggagggggccauuau

SEQ ID NO: 8752 - RNA, 20 nt, Homo sapiens
cuccggagggggccauuaug

SEQ ID NO: 8753 - RNA, 20 nt, Homo sapiens
uccggagggggccauuaugg

SEQ ID NO: 8754 - RNA, 20 nt, Homo sapiens
ggccauuaugggggacguca

SEQ ID NO: 8755 - RNA, 20 nt, Homo sapiens
cauuaugggggacgucaagg

SEQ ID NO: 8756 - RNA, 20 nt, Homo sapiens
ggggacgucaagguggaaga

SEQ ID NO: 8757 - RNA, 20 nt, Homo sapiens
uggugcugacgugagcaucu

SEQ ID NO: 8758 - RNA, 20 nt, Homo sapiens
ucucggaccucuucaacacc

SEQ ID NO: 8759 - RNA, 20 nt, Homo sapiens
cucggaccucuucaacacca

SEQ ID NO: 8760 - RNA, 20 nt, Homo sapiens
cuucaacaccaggguuaaca

SEQ ID NO: 8761 - RNA, 20 nt, Homo sapiens
uucaacaccaggguuaacaa

SEQ ID NO: 8762 - RNA, 20 nt, Homo sapiens
ccaggguuaacaagggcccg

SEQ ID NO: 8763 - RNA, 20 nt, Homo sapiens
caggguuaacaagggcccga

SEQ ID NO: 8764 - RNA, 20 nt, Homo sapiens
cccgagggugaccgugcuuu

SEQ ID NO: 8765 - RNA, 20 nt, Homo sapiens
ccgagggugaccgugcuuuu

SEQ ID NO: 8766 - RNA, 20 nt, Homo sapiens
cgagggugaccgugcuuuug

SEQ ID NO: 8767 - RNA, 20 nt, Homo sapiens
ggugaccgugcuuuugggga

SEQ ID NO: 8768 - RNA, 20 nt, Homo sapiens
accgugcuuuuggggaaggc

SEQ ID NO: 8769 - RNA, 20 nt, Homo sapiens
gcuuuuggggaaggcuggca

SEQ ID NO: 8770 - RNA, 20 nt, Homo sapiens
cuuuuggggaaggcuggcau

SEQ ID NO: 8771 - RNA, 20 nt, Homo sapiens
uggcaugggcaagaccacgc

SEQ ID NO: 8772 - RNA, 20 nt, Homo sapiens
gcaagaccacgcuggcccac

SEQ ID NO: 8773 - RNA, 20 nt, Homo sapiens
cccaccggcucugccagaag

SEQ ID NO: 8774 - RNA, 20 nt, Homo sapiens
ccaccggcucugccagaagu

SEQ ID NO: 8775 - RNA, 20 nt, Homo sapiens
gcucugccagaagugggcag

SEQ ID NO: 8776 - RNA, 20 nt, Homo sapiens
cucugccagaagugggcaga

SEQ ID NO: 8777 - RNA, 20 nt, Homo sapiens
gggccaucugaacuguuucc

SEQ ID NO: 8778 - RNA, 20 nt, Homo sapiens
gccagcucaacuugaucacg

SEQ ID NO: 8779 - RNA, 20 nt, Homo sapiens
ucuguaccugagcccugaau

SEQ ID NO: 8780 - RNA, 20 nt, Homo sapiens
cgacacugucuuccaguacc

SEQ ID NO: 8781 - RNA, 20 nt, Homo sapiens
caaguccugcugaucuuuga

SEQ ID NO: 8782 - RNA, 20 nt, Homo sapiens
aaguccugcugaucuuugau

SEQ ID NO: 8783 - RNA, 20 nt, Homo sapiens
gaucuuugaugggcuagaug

SEQ ID NO: 8784 - RNA, 20 nt, Homo sapiens
agaugaggcccuccagccua

SEQ ID NO: 8785 - RNA, 20 nt, Homo sapiens
gaugaggcccuccagccuau

SEQ ID NO: 8786 - RNA, 20 nt, Homo sapiens
cuccagccuauggguccuga

SEQ ID NO: 8787 - RNA, 20 nt, Homo sapiens
ccuauggguccugauggccc

SEQ ID NO: 8788 - RNA, 20 nt, Homo sapiens
cuuuucucccaucucugcaa

SEQ ID NO: 8789 - RNA, 20 nt, Homo sapiens
uuuucucccaucucugcaau

SEQ ID NO: 8790 - RNA, 20 nt, Homo sapiens
gccugccugccugccugcag

SEQ ID NO: 8791 - RNA, 20 nt, Homo sapiens
ccugccugcagaggcagcca

SEQ ID NO: 8792 - RNA, 20 nt, Homo sapiens
ggcagccaugguccacaugu

SEQ ID NO: 8793 - RNA, 20 nt, Homo sapiens
gcagccaugguccacauguu

SEQ ID NO: 8794 - RNA, 20 nt, Homo sapiens
guccacauguugggcuuuga

SEQ ID NO: 8795 - RNA, 20 nt, Homo sapiens
uccacauguugggcuuugau

SEQ ID NO: 8796 - RNA, 20 nt, Homo sapiens
uguugggcuuugaugggcca

SEQ ID NO: 8797 - RNA, 20 nt, Homo sapiens
guugggcuuugaugggccac

SEQ ID NO: 8798 - RNA, 20 nt, Homo sapiens
gggcuuugaugggccacggg

SEQ ID NO: 8799 - RNA, 20 nt, Homo sapiens
ucuucagcgcccagccaucg

SEQ ID NO: 8800 - RNA, 20 nt, Homo sapiens
cuucagcgcccagccaucgc

SEQ ID NO: 8801 - RNA, 20 nt, Homo sapiens
cagcgcccagccaucgcggg

SEQ ID NO: 8802 - RNA, 20 nt, Homo sapiens
agcgcccagccaucgcggga

SEQ ID NO: 8803 - RNA, 20 nt, Homo sapiens
gcgcccagccaucgcgggag

SEQ ID NO: 8804 - RNA, 20 nt, Homo sapiens
cgcccagccaucgcgggagg

SEQ ID NO: 8805 - RNA, 20 nt, Homo sapiens
gccaucgcgggagggggccc

SEQ ID NO: 8806 - RNA, 20 nt, Homo sapiens
aucgcgggagggggcccugg

SEQ ID NO: 8807 - RNA, 20 nt, Homo sapiens
cugguggaguuacagacaaa

SEQ ID NO: 8808 - RNA, 20 nt, Homo sapiens
acgucuccgaagccugugug

SEQ ID NO: 8809 - RNA, 20 nt, Homo sapiens
cugcuuccugaccacgcccc

SEQ ID NO: 8810 - RNA, 20 nt, Homo sapiens
ccacgccccaggccagucug

SEQ ID NO: 8811 - RNA, 20 nt, Homo sapiens
gacucagcucuauaugcaga

SEQ ID NO: 8812 - RNA, 20 nt, Homo sapiens
gugcucgcccucagcccccc

SEQ ID NO: 8813 - RNA, 20 nt, Homo sapiens
ugcucgcccucagccccccu

SEQ ID NO: 8814 - RNA, 20 nt, Homo sapiens
cuugcccaccucgucccuac

SEQ ID NO: 8815 - RNA, 20 nt, Homo sapiens
caccucgucccuacuggacc

SEQ ID NO: 8816 - RNA, 20 nt, Homo sapiens
accucgucccuacuggaccu

SEQ ID NO: 8817 - RNA, 20 nt, Homo sapiens
ccucgucccuacuggaccug

SEQ ID NO: 8818 - RNA, 20 nt, Homo sapiens
cucgucccuacuggaccugg

SEQ ID NO: 8819 - RNA, 20 nt, Homo sapiens
gucccuacuggaccuggggg

SEQ ID NO: 8820 - RNA, 20 nt, Homo sapiens
ccuacuggaccugggggagg

SEQ ID NO: 8821 - RNA, 20 nt, Homo sapiens
accugggggagguggcccug

SEQ ID NO: 8822 - RNA, 20 nt, Homo sapiens
ccugggggagguggcccuga

SEQ ID NO: 8823 - RNA, 20 nt, Homo sapiens
cugggggagguggcccugag

SEQ ID NO: 8824 - RNA, 20 nt, Homo sapiens
ggagguggcccugaggggcc

SEQ ID NO: 8825 - RNA, 20 nt, Homo sapiens
gcccugaggggccuggagac

SEQ ID NO: 8826 - RNA, 20 nt, Homo sapiens
cccugaggggccuggagaca

SEQ ID NO: 8827 - RNA, 20 nt, Homo sapiens
gaggggccuggagacaggga

SEQ ID NO: 8828 - RNA, 20 nt, Homo sapiens
gcuccacccuugauagcuuu

SEQ ID NO: 8829 - RNA, 20 nt, Homo sapiens
cuccacccuugauagcuuuu

SEQ ID NO: 8830 - RNA, 20 nt, Homo sapiens
uccacccuugauagcuuuug

SEQ ID NO: 8831 - RNA, 20 nt, Homo sapiens
acuuccuucugcgucugcac

SEQ ID NO: 8832 - RNA, 20 nt, Homo sapiens
uucugcgucugcacaggccc

SEQ ID NO: 8833 - RNA, 20 nt, Homo sapiens
ucugcgucugcacaggcccu

SEQ ID NO: 8834 - RNA, 20 nt, Homo sapiens
ggcccugggcaccagcagac

SEQ ID NO: 8835 - RNA, 20 nt, Homo sapiens
uuucacccaccucagccugc

SEQ ID NO: 8836 - RNA, 20 nt, Homo sapiens
ucuugcugcccugcaccuga

SEQ ID NO: 8837 - RNA, 20 nt, Homo sapiens
gcaccugauggccagcccca

SEQ ID NO: 8838 - RNA, 20 nt, Homo sapiens
auguuacccuccauucccgc

SEQ ID NO: 8839 - RNA, 20 nt, Homo sapiens
uguuacccuccauucccgcu

SEQ ID NO: 8840 - RNA, 20 nt, Homo sapiens
uccauucccgcuggguacag

SEQ ID NO: 8841 - RNA, 20 nt, Homo sapiens
acagcggaccaaagcuagac

SEQ ID NO: 8842 - RNA, 20 nt, Homo sapiens
cagcggaccaaagcuagacu

SEQ ID NO: 8843 - RNA, 20 nt, Homo sapiens
agaccaccuccccaccuucc

SEQ ID NO: 8844 - RNA, 20 nt, Homo sapiens
ccaccuccccaccuuccugg

SEQ ID NO: 8845 - RNA, 20 nt, Homo sapiens
caccuccccaccuuccuggc

SEQ ID NO: 8846 - RNA, 20 nt, Homo sapiens
ccccaccuuccuggcgggcc

SEQ ID NO: 8847 - RNA, 20 nt, Homo sapiens
ccgccccuuccuuagccacc

SEQ ID NO: 8848 - RNA, 20 nt, Homo sapiens
cuuccuuagccaccuggcgc

SEQ ID NO: 8849 - RNA, 20 nt, Homo sapiens
uuccuuagccaccuggcgca

SEQ ID NO: 8850 - RNA, 20 nt, Homo sapiens
ccaccuggcgcagggcaaug

SEQ ID NO: 8851 - RNA, 20 nt, Homo sapiens
gcagggcaaugaggacugug

SEQ ID NO: 8852 - RNA, 20 nt, Homo sapiens
cagggcaaugaggacugugu

SEQ ID NO: 8853 - RNA, 20 nt, Homo sapiens
ggacugugugggugccaagc

SEQ ID NO: 8854 - RNA, 20 nt, Homo sapiens
caagcaggcugcuguagugc

SEQ ID NO: 8855 - RNA, 20 nt, Homo sapiens
agugcagguguugaagaagu

SEQ ID NO: 8856 - RNA, 20 nt, Homo sapiens
uuggccacccgcaagcucac

SEQ ID NO: 8857 - RNA, 20 nt, Homo sapiens
uggccacccgcaagcucaca

SEQ ID NO: 8858 - RNA, 20 nt, Homo sapiens
ccgcaagcucacagggccaa

SEQ ID NO: 8859 - RNA, 20 nt, Homo sapiens
uguagagcugugucacugug

SEQ ID NO: 8860 - RNA, 20 nt, Homo sapiens
ucacuguguggaugagacac

SEQ ID NO: 8861 - RNA, 20 nt, Homo sapiens
ugagacacaggagccugagc

SEQ ID NO: 8862 - RNA, 20 nt, Homo sapiens
cccacugaccugcaccgacc

SEQ ID NO: 8863 - RNA, 20 nt, Homo sapiens
ugaccaacauccuagagcac

SEQ ID NO: 8864 - RNA, 20 nt, Homo sapiens
gaccaacauccuagagcaca

SEQ ID NO: 8865 - RNA, 20 nt, Homo sapiens
caacauccuagagcacaggg

SEQ ID NO: 8866 - RNA, 20 nt, Homo sapiens
cagggaggcccccauccacc

SEQ ID NO: 8867 - RNA, 20 nt, Homo sapiens
cccauccaccuggauuuuga

SEQ ID NO: 8868 - RNA, 20 nt, Homo sapiens
ggauuuugauggcugucccc

SEQ ID NO: 8869 - RNA, 20 nt, Homo sapiens
ccuggagccccacugcccug

SEQ ID NO: 8870 - RNA, 20 nt, Homo sapiens
gccccacugcccugaggcuc

SEQ ID NO: 8871 - RNA, 20 nt, Homo sapiens
cacugcccugaggcucuggu

SEQ ID NO: 8872 - RNA, 20 nt, Homo sapiens
ccugaggcucugguaggcug

SEQ ID NO: 8873 - RNA, 20 nt, Homo sapiens
cugaggcucugguaggcugu

SEQ ID NO: 8874 - RNA, 20 nt, Homo sapiens
gugggcagauagagaaucuc

SEQ ID NO: 8875 - RNA, 20 nt, Homo sapiens
gaaucucaggugaguaagag

SEQ ID NO: 8876 - RNA, 20 nt, Homo sapiens
ucucaggugaguaagagugg

SEQ ID NO: 8877 - RNA, 20 nt, Homo sapiens
caggugaguaagaguggagg

SEQ ID NO: 8878 - RNA, 20 nt, Homo sapiens
ggccaacucugcaaggggca

SEQ ID NO: 8879 - RNA, 20 nt, Homo sapiens
uggccaacucugcaaggggc

SEQ ID NO: 8880 - RNA, 20 nt, Homo sapiens
uucuuggccaacucugcaag

SEQ ID NO: 8881 - RNA, 20 nt, Homo sapiens
cuucuuggccaacucugcaa

SEQ ID NO: 8882 - RNA, 20 nt, Homo sapiens
acuucuuggccaacucugca

SEQ ID NO: 8883 - RNA, 20 nt, Homo sapiens
caggagcugcagguacuucu

SEQ ID NO: 8884 - RNA, 20 nt, Homo sapiens
cagagguccgcaggagcugc

SEQ ID NO: 8885 - RNA, 20 nt, Homo sapiens
gcugcugggcagagguccgc

SEQ ID NO: 8886 - RNA, 20 nt, Homo sapiens
ccuguagcgcugcugggcag

SEQ ID NO: 8887 - RNA, 20 nt, Homo sapiens
uuggcuccuguagcgcugcu

SEQ ID NO: 8888 - RNA, 20 nt, Homo sapiens
uuuggcuccuguagcgcugc

SEQ ID NO: 8889 - RNA, 20 nt, Homo sapiens
gcugcccugacccagggauu

SEQ ID NO: 8890 - RNA, 20 nt, Homo sapiens
cguggggcugcccugaccca

SEQ ID NO: 8891 - RNA, 20 nt, Homo sapiens
gcguggggcugcccugaccc

SEQ ID NO: 8892 - RNA, 20 nt, Homo sapiens
uagaccugguggaaggcgug

SEQ ID NO: 8893 - RNA, 20 nt, Homo sapiens
auagaccugguggaaggcgu

SEQ ID NO: 8894 - RNA, 20 nt, Homo sapiens
cauagaccugguggaaggcg

SEQ ID NO: 8895 - RNA, 20 nt, Homo sapiens
agggacauagaccuggugga

SEQ ID NO: 8896 - RNA, 20 nt, Homo sapiens
uuggagggacauagaccugg

SEQ ID NO: 8897 - RNA, 20 nt, Homo sapiens
ggauuggagggacauagacc

SEQ ID NO: 8898 - RNA, 20 nt, Homo sapiens
uggcccggcgcaggauugga

SEQ ID NO: 8899 - RNA, 20 nt, Homo sapiens
guggcccggcgcaggauugg

SEQ ID NO: 8900 - RNA, 20 nt, Homo sapiens
gcuguggcccggcgcaggau

SEQ ID NO: 8901 - RNA, 20 nt, Homo sapiens
aggaugcuguggcccggcgc

SEQ ID NO: 8902 - RNA, 20 nt, Homo sapiens
ugucuaaggaugcuguggcc

SEQ ID NO: 8903 - RNA, 20 nt, Homo sapiens
cggagugucuaaggaugcug

SEQ ID NO: 8904 - RNA, 20 nt, Homo sapiens
ggcccccuccggagugucua

SEQ ID NO: 8905 - RNA, 20 nt, Homo sapiens
ucccccauaauggcccccuc

SEQ ID NO: 8906 - RNA, 20 nt, Homo sapiens
caccuugacgucccccauaa

SEQ ID NO: 8907 - RNA, 20 nt, Homo sapiens
uguuaacccugguguugaag

SEQ ID NO: 8908 - RNA, 20 nt, Homo sapiens
ccucgggcccuuguuaaccc

SEQ ID NO: 8909 - RNA, 20 nt, Homo sapiens
ccaaaagcacggucacccuc

SEQ ID NO: 8910 - RNA, 20 nt, Homo sapiens
cccaaaagcacggucacccu

SEQ ID NO: 8911 - RNA, 20 nt, Homo sapiens
gccagccuuccccaaaagca

SEQ ID NO: 8912 - RNA, 20 nt, Homo sapiens
gcagagccggugggccagcg

SEQ ID NO: 8913 - RNA, 20 nt, Homo sapiens
ccacuucuggcagagccggu

SEQ ID NO: 8914 - RNA, 20 nt, Homo sapiens
cccacuucuggcagagccgg

SEQ ID NO: 8915 - RNA, 20 nt, Homo sapiens
cugcccacuucuggcagagc

SEQ ID NO: 8916 - RNA, 20 nt, Homo sapiens
gauggcccucugcccacuuc

SEQ ID NO: 8917 - RNA, 20 nt, Homo sapiens
gggccuggaaacaguucaga

SEQ ID NO: 8918 - RNA, 20 nt, Homo sapiens
auucaaaaaggaacagggcc

SEQ ID NO: 8919 - RNA, 20 nt, Homo sapiens
gcggaauucaaaaaggaaca

SEQ ID NO: 8920 - RNA, 20 nt, Homo sapiens
ggcggaauucaaaaaggaac

SEQ ID NO: 8921 - RNA, 20 nt, Homo sapiens
ugagcuggcggaauucaaaa

SEQ ID NO: 8922 - RNA, 20 nt, Homo sapiens
ucgugaucaaguugagcugg

SEQ ID NO: 8923 - RNA, 20 nt, Homo sapiens
accucgugaucaaguugagc

SEQ ID NO: 8924 - RNA, 20 nt, Homo sapiens
aaaggagcucggacgguguc

SEQ ID NO: 8925 - RNA, 20 nt, Homo sapiens
agaucaaaaaggagcucgga

SEQ ID NO: 8926 - RNA, 20 nt, Homo sapiens
guacagaucaaaaaggagcu

SEQ ID NO: 8927 - RNA, 20 nt, Homo sapiens
ggcucagguacagaucaaaa

SEQ ID NO: 8928 - RNA, 20 nt, Homo sapiens
cgugguccgauucagggcuc

SEQ ID NO: 8929 - RNA, 20 nt, Homo sapiens
cagugucgugguccgauuca

SEQ ID NO: 8930 - RNA, 20 nt, Homo sapiens
acagugucgugguccgauuc

SEQ ID NO: 8931 - RNA, 20 nt, Homo sapiens
gguacuggaagacagugucg

SEQ ID NO: 8932 - RNA, 20 nt, Homo sapiens
cagcguucuucuccagguac

SEQ ID NO: 8933 - RNA, 20 nt, Homo sapiens
cuuggucagcguucuucucc

SEQ ID NO: 8934 - RNA, 20 nt, Homo sapiens
caucaaagaucagcaggacu

SEQ ID NO: 8935 - RNA, 20 nt, Homo sapiens
cuagcccaucaaagaucagc

SEQ ID NO: 8936 - RNA, 20 nt, Homo sapiens
aucaggacccauaggcugga

SEQ ID NO: 8937 - RNA, 20 nt, Homo sapiens
caucaggacccauaggcugg

SEQ ID NO: 8938 - RNA, 20 nt, Homo sapiens
ggccaucaggacccauaggc

SEQ ID NO: 8939 - RNA, 20 nt, Homo sapiens
ccugggccaucaggacccau

SEQ ID NO: 8940 - RNA, 20 nt, Homo sapiens
aggacugggccugggccauc

SEQ ID NO: 8941 - RNA, 20 nt, Homo sapiens
aaagggugaggacugggccu

SEQ ID NO: 8942 - RNA, 20 nt, Homo sapiens
aaaagggugaggacugggcc

SEQ ID NO: 8943 - RNA, 20 nt, Homo sapiens
gggagaaaagggugaggacu

SEQ ID NO: 8944 - RNA, 20 nt, Homo sapiens
ugggagaaaagggugaggac

SEQ ID NO: 8945 - RNA, 20 nt, Homo sapiens
agagaugggagaaaagggug

SEQ ID NO: 8946 - RNA, 20 nt, Homo sapiens
auugcagagaugggagaaaa

SEQ ID NO: 8947 - RNA, 20 nt, Homo sapiens
cauugcagagaugggagaaa

SEQ ID NO: 8948 - RNA, 20 nt, Homo sapiens
cuccgucccauugcagagau

SEQ ID NO: 8949 - RNA, 20 nt, Homo sapiens
ccuccgucccauugcagaga

SEQ ID NO: 8950 - RNA, 20 nt, Homo sapiens
aaagcccaacauguggacca

SEQ ID NO: 8951 - RNA, 20 nt, Homo sapiens
gcccaucaaagcccaacaug

SEQ ID NO: 8952 - RNA, 20 nt, Homo sapiens
uucacauauucuuccacccg

SEQ ID NO: 8953 - RNA, 20 nt, Homo sapiens
ggcccccucccgcgauggcu

SEQ ID NO: 8954 - RNA, 20 nt, Homo sapiens
gggcccccucccgcgauggc

SEQ ID NO: 8955 - RNA, 20 nt, Homo sapiens
accagggcccccucccgcga

SEQ ID NO: 8956 - RNA, 20 nt, Homo sapiens
auuugucuguaacuccacca

SEQ ID NO: 8957 - RNA, 20 nt, Homo sapiens
cauuugucuguaacuccacc

SEQ ID NO: 8958 - RNA, 20 nt, Homo sapiens
cgggcaccgcacacaggcuu

SEQ ID NO: 8959 - RNA, 20 nt, Homo sapiens
acagugcgggcaccgcacac

SEQ ID NO: 8960 - RNA, 20 nt, Homo sapiens
caggcgacuuggcacagugc

SEQ ID NO: 8961 - RNA, 20 nt, Homo sapiens
acaggcgacuuggcacagug

SEQ ID NO: 8962 - RNA, 20 nt, Homo sapiens
ggaggcagagacaggcgacu

SEQ ID NO: 8963 - RNA, 20 nt, Homo sapiens
cagaugguggaggcagagac

SEQ ID NO: 8964 - RNA, 20 nt, Homo sapiens
ggucaggaagcagauggugg

SEQ ID NO: 8965 - RNA, 20 nt, Homo sapiens
cguggucaggaagcagaugg

SEQ ID NO: 8966 - RNA, 20 nt, Homo sapiens
gggcguggucaggaagcaga

SEQ ID NO: 8967 - RNA, 20 nt, Homo sapiens
gacuggccuggggcgugguc

SEQ ID NO: 8968 - RNA, 20 nt, Homo sapiens
ccacagacuggccuggggcg

SEQ ID NO: 8969 - RNA, 20 nt, Homo sapiens
gagggccacagacuggccug

SEQ ID NO: 8970 - RNA, 20 nt, Homo sapiens
ggagggccacagacuggccu

SEQ ID NO: 8971 - RNA, 20 nt, Homo sapiens
aggagggccacagacuggcc

SEQ ID NO: 8972 - RNA, 20 nt, Homo sapiens
ugggcaggagggccacagac

SEQ ID NO: 8973 - RNA, 20 nt, Homo sapiens
cugagucauguugggcagga

SEQ ID NO: 8974 - RNA, 20 nt, Homo sapiens
gcugagucauguugggcagg

SEQ ID NO: 8975 - RNA, 20 nt, Homo sapiens
agagcugagucauguugggc

SEQ ID NO: 8976 - RNA, 20 nt, Homo sapiens
auauagagcugagucauguu

SEQ ID NO: 8977 - RNA, 20 nt, Homo sapiens
cauauagagcugagucaugu

SEQ ID NO: 8978 - RNA, 20 nt, Homo sapiens
caagugcccaggggggcuga

SEQ ID NO: 8979 - RNA, 20 nt, Homo sapiens
gcaagugcccaggggggcug

SEQ ID NO: 8980 - RNA, 20 nt, Homo sapiens
aggugggcaagugcccaggg

SEQ ID NO: 8981 - RNA, 20 nt, Homo sapiens
gaggugggcaagugcccagg

SEQ ID NO: 8982 - RNA, 20 nt, Homo sapiens
cgaggugggcaagugcccag

SEQ ID NO: 8983 - RNA, 20 nt, Homo sapiens
acgaggugggcaagugccca

SEQ ID NO: 8984 - RNA, 20 nt, Homo sapiens
gacgaggugggcaagugccc

SEQ ID NO: 8985 - RNA, 20 nt, Homo sapiens
agguccaguagggacgaggu

SEQ ID NO: 8986 - RNA, 20 nt, Homo sapiens
cagguccaguagggacgagg

SEQ ID NO: 8987 - RNA, 20 nt, Homo sapiens
ccccagguccaguagggacg

SEQ ID NO: 8988 - RNA, 20 nt, Homo sapiens
caccucccccagguccagua

SEQ ID NO: 8989 - RNA, 20 nt, Homo sapiens
ccaccucccccagguccagu

SEQ ID NO: 8990 - RNA, 20 nt, Homo sapiens
cccucagggccaccuccccc

SEQ ID NO: 8991 - RNA, 20 nt, Homo sapiens
cccugucuccaggccccuca

SEQ ID NO: 8992 - RNA, 20 nt, Homo sapiens
ucccugucuccaggccccuc

SEQ ID NO: 8993 - RNA, 20 nt, Homo sapiens
agauaaccuucccugucucc

SEQ ID NO: 8994 - RNA, 20 nt, Homo sapiens
gccccaaaagcuaucaaggg

SEQ ID NO: 8995 - RNA, 20 nt, Homo sapiens
guggccccaaaagcuaucaa

SEQ ID NO: 8996 - RNA, 20 nt, Homo sapiens
aguggccccaaaagcuauca

SEQ ID NO: 8997 - RNA, 20 nt, Homo sapiens
ggaagucagcaggcugugag

SEQ ID NO: 8998 - RNA, 20 nt, Homo sapiens
agacgcagaaggaagucagc

SEQ ID NO: 8999 - RNA, 20 nt, Homo sapiens
agggccugugcagacgcaga

SEQ ID NO: 9000 - RNA, 20 nt, Homo sapiens
agccugucugcuggugccca

SEQ ID NO: 9001 - RNA, 20 nt, Homo sapiens
uagccugucugcuggugccc

SEQ ID NO: 9002 - RNA, 20 nt, Homo sapiens
ugaaagcauagccugucugc

SEQ ID NO: 9003 - RNA, 20 nt, Homo sapiens
aaacuccugcaggcugaggu

SEQ ID NO: 9004 - RNA, 20 nt, Homo sapiens
gaaacuccugcaggcugagg

SEQ ID NO: 9005 - RNA, 20 nt, Homo sapiens
caagaaacuccugcaggcug

SEQ ID NO: 9006 - RNA, 20 nt, Homo sapiens
gggcagcaagaaacuccugc

SEQ ID NO: 9007 - RNA, 20 nt, Homo sapiens
ggggcuggccaucaggugca

SEQ ID NO: 9008 - RNA, 20 nt, Homo sapiens
uggggcuggccaucaggugc

SEQ ID NO: 9009 - RNA, 20 nt, Homo sapiens
ucaccuuggggcuggccauc

SEQ ID NO: 9010 - RNA, 20 nt, Homo sapiens
gucuuuguucaccuuggggc

SEQ ID NO: 9011 - RNA, 20 nt, Homo sapiens
gugugucuuuguucaccuug

SEQ ID NO: 9012 - RNA, 20 nt, Homo sapiens
agugugucuuuguucaccuu

SEQ ID NO: 9013 - RNA, 20 nt, Homo sapiens
aagugugucuuuguucaccu

SEQ ID NO: 9014 - RNA, 20 nt, Homo sapiens
ggaauggaggguaacauacu

SEQ ID NO: 9015 - RNA, 20 nt, Homo sapiens
gggaauggaggguaacauac

SEQ ID NO: 9016 - RNA, 20 nt, Homo sapiens
cuguacccagcgggaaugga

SEQ ID NO: 9017 - RNA, 20 nt, Homo sapiens
gcuguacccagcgggaaugg

SEQ ID NO: 9018 - RNA, 20 nt, Homo sapiens
uccgcuguacccagcgggaa

SEQ ID NO: 9019 - RNA, 20 nt, Homo sapiens
uuugguccgcuguacccagc

SEQ ID NO: 9020 - RNA, 20 nt, Homo sapiens
cuuugguccgcuguacccag

SEQ ID NO: 9021 - RNA, 20 nt, Homo sapiens
ugagaggcccagucuagcuu

SEQ ID NO: 9022 - RNA, 20 nt, Homo sapiens
agguggggagguggucugag

SEQ ID NO: 9023 - RNA, 20 nt, Homo sapiens
ccgccaggaagguggggagg

SEQ ID NO: 9024 - RNA, 20 nt, Homo sapiens
ggcccgccaggaaggugggg

SEQ ID NO: 9025 - RNA, 20 nt, Homo sapiens
ccaggcccgccaggaaggug

SEQ ID NO: 9026 - RNA, 20 nt, Homo sapiens
gccaggcccgccaggaaggu

SEQ ID NO: 9027 - RNA, 20 nt, Homo sapiens
ugccaggcccgccaggaagg

SEQ ID NO: 9028 - RNA, 20 nt, Homo sapiens
ggaugccaggcccgccagga

SEQ ID NO: 9029 - RNA, 20 nt, Homo sapiens
ugcaggaugccaggcccgcc

SEQ ID NO: 9030 - RNA, 20 nt, Homo sapiens
ggcggcaggugcaggaugcc

SEQ ID NO: 9031 - RNA, 20 nt, Homo sapiens
aaggaaggggcggcaggugc

SEQ ID NO: 9032 - RNA, 20 nt, Homo sapiens
guggcuaaggaaggggcggc

SEQ ID NO: 9033 - RNA, 20 nt, Homo sapiens
ccagguggcuaaggaagggg

SEQ ID NO: 9034 - RNA, 20 nt, Homo sapiens
gcgccagguggcuaaggaag

SEQ ID NO: 9035 - RNA, 20 nt, Homo sapiens
ugcgccagguggcuaaggaa

SEQ ID NO: 9036 - RNA, 20 nt, Homo sapiens
cugcgccagguggcuaagga

SEQ ID NO: 9037 - RNA, 20 nt, Homo sapiens
ugcccugcgccagguggcua

SEQ ID NO: 9038 - RNA, 20 nt, Homo sapiens
ccucauugcccugcgccagg

SEQ ID NO: 9039 - RNA, 20 nt, Homo sapiens
aguccucauugcccugcgcc

SEQ ID NO: 9040 - RNA, 20 nt, Homo sapiens
cugcacuacagcagccugcu

SEQ ID NO: 9041 - RNA, 20 nt, Homo sapiens
uggcccugugagcuugcggg

SEQ ID NO: 9042 - RNA, 20 nt, Homo sapiens
cuuuggcccugugagcuugc

SEQ ID NO: 9043 - RNA, 20 nt, Homo sapiens
ccuuuggcccugugagcuug

SEQ ID NO: 9044 - RNA, 20 nt, Homo sapiens
ugacacagcucuacaaccuu

SEQ ID NO: 9045 - RNA, 20 nt, Homo sapiens
gcggugagacuggccagcuc

SEQ ID NO: 9046 - RNA, 20 nt, Homo sapiens
gaggcuuugugcggugagac

SEQ ID NO: 9047 - RNA, 20 nt, Homo sapiens
uugauaggggaggcuuugug

SEQ ID NO: 9048 - RNA, 20 nt, Homo sapiens
ggaagggcaguugauagggg

SEQ ID NO: 9049 - RNA, 20 nt, Homo sapiens
uguggaagggcaguugauag

SEQ ID NO: 9050 - RNA, 20 nt, Homo sapiens
uuguggaagggcaguugaua

SEQ ID NO: 9051 - RNA, 20 nt, Homo sapiens
auuguggaagggcaguugau

SEQ ID NO: 9052 - RNA, 20 nt, Homo sapiens
gucagugggaaauuguggaa

SEQ ID NO: 9053 - RNA, 20 nt, Homo sapiens
ggucagugggaaauugugga

SEQ ID NO: 9054 - RNA, 20 nt, Homo sapiens
ugcaggucagugggaaauug

SEQ ID NO: 9055 - RNA, 20 nt, Homo sapiens
ccaggucggugcaggucagu

SEQ ID NO: 9056 - RNA, 20 nt, Homo sapiens
gccaggucggugcaggucag

SEQ ID NO: 9057 - RNA, 20 nt, Homo sapiens
caggguggccaggucggugc

SEQ ID NO: 9058 - RNA, 20 nt, Homo sapiens
guuggucaggguggccaggu

SEQ ID NO: 9059 - RNA, 20 nt, Homo sapiens
ggauguuggucaggguggcc

SEQ ID NO: 9060 - RNA, 20 nt, Homo sapiens
cucuaggauguuggucaggg

SEQ ID NO: 9061 - RNA, 20 nt, Homo sapiens
gugcucuaggauguugguca

SEQ ID NO: 9062 - RNA, 20 nt, Homo sapiens
ugugcucuaggauguugguc

SEQ ID NO: 9063 - RNA, 20 nt, Homo sapiens
cucccugugcucuaggaugu

SEQ ID NO: 9064 - RNA, 20 nt, Homo sapiens
ugggggccucccugugcucu

SEQ ID NO: 9065 - RNA, 20 nt, Homo sapiens
aucaaaauccagguggaugg

SEQ ID NO: 9066 - RNA, 20 nt, Homo sapiens
caucaaaauccagguggaug

SEQ ID NO: 9067 - RNA, 20 nt, Homo sapiens
ccaucaaaauccagguggau

SEQ ID NO: 9068 - RNA, 20 nt, Homo sapiens
gccaucaaaauccaggugga

SEQ ID NO: 9069 - RNA, 20 nt, Homo sapiens
gacagccaucaaaauccagg

SEQ ID NO: 9070 - RNA, 20 nt, Homo sapiens
ggggacagccaucaaaaucc

SEQ ID NO: 9071 - RNA, 20 nt, Homo sapiens
ucagggcaguggggcuccag

SEQ ID NO: 9072 - RNA, 20 nt, Homo sapiens
cucagggcaguggggcucca

SEQ ID NO: 9073 - RNA, 20 nt, Homo sapiens
ccucagggcaguggggcucc

SEQ ID NO: 9074 - RNA, 20 nt, Homo sapiens
accagagccucagggcagug

SEQ ID NO: 9075 - RNA, 20 nt, Homo sapiens
uaccagagccucagggcagu

SEQ ID NO: 9076 - RNA, 20 nt, Homo sapiens
cuaccagagccucagggcag

SEQ ID NO: 9077 - RNA, 20 nt, Homo sapiens
cacagccuaccagagccuca

SEQ ID NO: 9078 - RNA, 20 nt, Homo sapiens
ccacagccuaccagagccuc

SEQ ID NO: 9079 - RNA, 20 nt, Homo sapiens
cuuauggcagcuuuaagagc

SEQ ID NO: 9080 - RNA, 20 nt, Homo sapiens
agcuuuaagagcaggaagug

SEQ ID NO: 9081 - RNA, 20 nt, Homo sapiens
gcuuuaagagcaggaagugu

SEQ ID NO: 9082 - RNA, 20 nt, Homo sapiens
cuuuaagagcaggaagugug

SEQ ID NO: 9083 - RNA, 20 nt, Homo sapiens
ccuuugcagaagcccucucc

SEQ ID NO: 9084 - RNA, 20 nt, Homo sapiens
cuccaggagcuugccgacaa

SEQ ID NO: 9085 - RNA, 20 nt, Homo sapiens
uccaggagcuugccgacaau

SEQ ID NO: 9086 - RNA, 20 nt, Homo sapiens
ccaggagcuugccgacaaug

SEQ ID NO: 9087 - RNA, 20 nt, Homo sapiens
ggagcuugccgacaaugggg

SEQ ID NO: 9088 - RNA, 20 nt, Homo sapiens
aauggggaggcugcagaugc

SEQ ID NO: 9089 - RNA, 20 nt, Homo sapiens
auggggaggcugcagaugcu

SEQ ID NO: 9090 - RNA, 20 nt, Homo sapiens
uggggaggcugcagaugcug

SEQ ID NO: 9091 - RNA, 20 nt, Homo sapiens
ugcagaugcuggggugagcc

SEQ ID NO: 9092 - RNA, 20 nt, Homo sapiens
ugcuggggugagccaggccu

SEQ ID NO: 9093 - RNA, 20 nt, Homo sapiens
ccuggagagggcuucugcaa

SEQ ID NO: 9094 - RNA, 20 nt, Homo sapiens
ugucggcaagcuccuggaga

SEQ ID NO: 9095 - RNA, 20 nt, Homo sapiens
uugucggcaagcuccuggag

SEQ ID NO: 9096 - RNA, 20 nt, Homo sapiens
ccccauugucggcaagcucc

SEQ ID NO: 9097 - RNA, 20 nt, Homo sapiens
aucugcagccuccccauugu

SEQ ID NO: 9098 - RNA, 20 nt, Homo sapiens
ugcuuacucuguagguuagc

SEQ ID NO: 9099 - RNA, 20 nt, Homo sapiens
ggaaguaaaaucacugcccg

SEQ ID NO: 9100 - RNA, 20 nt, Homo sapiens
ugcccgaggcaucagccacc

SEQ ID NO: 9101 - RNA, 20 nt, Homo sapiens
guccacagcugaaagaaguc

SEQ ID NO: 9102 - RNA, 20 nt, Homo sapiens
aagucaggugagugaucucc

SEQ ID NO: 9103 - RNA, 20 nt, Homo sapiens
ucaggugagugaucuccagg

SEQ ID NO: 9104 - RNA, 20 nt, Homo sapiens
caggugagugaucuccagga

SEQ ID NO: 9105 - RNA, 20 nt, Homo sapiens
caccagguggcugaugccuc

SEQ ID NO: 9106 - RNA, 20 nt, Homo sapiens
ucaccagguggcugaugccu

SEQ ID NO: 9107 - RNA, 20 nt, Homo sapiens
gaggcaaagcuuucaccagg

SEQ ID NO: 9108 - RNA, 20 nt, Homo sapiens
agagaggcaaagcuuucacc

SEQ ID NO: 9109 - RNA, 20 nt, Homo sapiens
ucuuucagcuguggacagag

SEQ ID NO: 9110 - RNA, 20 nt, Homo sapiens
caccugacuucuuucagcug

SEQ ID NO: 9111 - RNA, 20 nt, Homo sapiens
cuuggucuccucgcaguuuu

SEQ ID NO: 9112 - RNA, 20 nt, Homo sapiens
uuggucuccucgcaguuuuc

SEQ ID NO: 9113 - RNA, 20 nt, Homo sapiens
ggacaaccagcucagugacc

SEQ ID NO: 9114 - RNA, 20 nt, Homo sapiens
caaccagcucagugaccagg

SEQ ID NO: 9115 - RNA, 20 nt, Homo sapiens
ccagguggugcugaacauug

SEQ ID NO: 9116 - RNA, 20 nt, Homo sapiens
gguggugcugaacauugugg

SEQ ID NO: 9117 - RNA, 20 nt, Homo sapiens
agguucucccucaccuacca

SEQ ID NO: 9118 - RNA, 20 nt, Homo sapiens
ucccucaccuaccacggcuc

SEQ ID NO: 9119 - RNA, 20 nt, Homo sapiens
cgaaaacugcgaggagacca

SEQ ID NO: 9120 - RNA, 20 nt, Homo sapiens
ugguugucccgaaaacugcg

SEQ ID NO: 9121 - RNA, 20 nt, Homo sapiens
gcaccaccuggucacugagc

SEQ ID NO: 9122 - RNA, 20 nt, Homo sapiens
ccacaauguucagcaccacc

SEQ ID NO: 9123 - RNA, 20 nt, Homo sapiens
uccggagccgugguagguga

SEQ ID NO: 9124 - RNA, 20 nt, Homo sapiens
uuccggagccgugguaggug

SEQ ID NO: 9125 - RNA, 20 nt, Homo sapiens
caagcuuccggagccguggu

SEQ ID NO: 9126 - RNA, 20 nt, Homo sapiens
uacucaagcuuccggagccg

SEQ ID NO: 9127 - RNA, 20 nt, Homo sapiens
agaucacuuacucaagcuuc

SEQ ID NO: 9128 - RNA, 20 nt, Homo sapiens
cgugucaacccuacucugcu

SEQ ID NO: 9129 - RNA, 20 nt, Homo sapiens
caacccuacucugcuuggca

SEQ ID NO: 9130 - RNA, 20 nt, Homo sapiens
aacccuacucugcuuggcaa

SEQ ID NO: 9131 - RNA, 20 nt, Homo sapiens
ccuacucugcuuggcaaggg

SEQ ID NO: 9132 - RNA, 20 nt, Homo sapiens
cagucacguguccuaccguc

SEQ ID NO: 9133 - RNA, 20 nt, Homo sapiens
uccuaccgucaggaugcuuc

SEQ ID NO: 9134 - RNA, 20 nt, Homo sapiens
ccgucaggaugcuucaggcc

SEQ ID NO: 9135 - RNA, 20 nt, Homo sapiens
cuucaggccaggugagcaga

SEQ ID NO: 9136 - RNA, 20 nt, Homo sapiens
ggccaggugagcagaaggaa

SEQ ID NO: 9137 - RNA, 20 nt, Homo sapiens
gccaggugagcagaaggaaa

SEQ ID NO: 9138 - RNA, 20 nt, Homo sapiens
aggcugcaagauuguggcaa

SEQ ID NO: 9139 - RNA, 20 nt, Homo sapiens
cugcucaggcugcaagauug

SEQ ID NO: 9140 - RNA, 20 nt, Homo sapiens
cgcagaugcuguugcugcuc

SEQ ID NO: 9141 - RNA, 20 nt, Homo sapiens
cacccuugccaagcagagua

SEQ ID NO: 9142 - RNA, 20 nt, Homo sapiens
ccacccuugccaagcagagu

SEQ ID NO: 9143 - RNA, 20 nt, Homo sapiens
gccugaagcauccugacggu

SEQ ID NO: 9144 - RNA, 20 nt, Homo sapiens
ccuggccugaagcauccuga

SEQ ID NO: 9145 - RNA, 20 nt, Homo sapiens
ucccuuuccuucugcucacc

SEQ ID NO: 9146 - RNA, 20 nt, Homo sapiens
ugguaucugauccugcaggg

SEQ ID NO: 9147 - RNA, 20 nt, Homo sapiens
uaucugauccugcagggagg

SEQ ID NO: 9148 - RNA, 20 nt, Homo sapiens
agacaacugcagagcuacaa

SEQ ID NO: 9149 - RNA, 20 nt, Homo sapiens
uacaaagguaagaagccaag

SEQ ID NO: 9150 - RNA, 20 nt, Homo sapiens
aaagguaagaagccaagagg

SEQ ID NO: 9151 - RNA, 20 nt, Homo sapiens
gaugagguccgccucccugc

SEQ ID NO: 9152 - RNA, 20 nt, Homo sapiens
gcggggaaagaaggaagaug

SEQ ID NO: 9153 - RNA, 20 nt, Homo sapiens
ucucugugggcggggaaaga

SEQ ID NO: 9154 - RNA, 20 nt, Homo sapiens
ugcaguugucucugugggcg

SEQ ID NO: 9155 - RNA, 20 nt, Homo sapiens
cugcaguugucucugugggc

SEQ ID NO: 9156 - RNA, 20 nt, Homo sapiens
ucugcaguugucucuguggg

SEQ ID NO: 9157 - RNA, 20 nt, Homo sapiens
agcucugcaguugucucugu

SEQ ID NO: 9158 - RNA, 20 nt, Homo sapiens
uagcucugcaguugucucug

SEQ ID NO: 9159 - RNA, 20 nt, Homo sapiens
ugccagagcuccagaccugc

SEQ ID NO: 9160 - RNA, 20 nt, Homo sapiens
ccagaccugcaggaaaguga

SEQ ID NO: 9161 - RNA, 20 nt, Homo sapiens
ugcaggaaagugacggccag

SEQ ID NO: 9162 - RNA, 20 nt, Homo sapiens
gaaagugacggccagaggaa

SEQ ID NO: 9163 - RNA, 20 nt, Homo sapiens
aaagugacggccagaggaaa

SEQ ID NO: 9164 - RNA, 20 nt, Homo sapiens
aagugacggccagaggaaag

SEQ ID NO: 9165 - RNA, 20 nt, Homo sapiens
agagcagaagcuugacgcuc

SEQ ID NO: 9166 - RNA, 20 nt, Homo sapiens
agcuugacgcucagguaccu

SEQ ID NO: 9167 - RNA, 20 nt, Homo sapiens
uugacgcucagguaccuugg

SEQ ID NO: 9168 - RNA, 20 nt, Homo sapiens
ugacgcucagguaccuugga

SEQ ID NO: 9169 - RNA, 20 nt, Homo sapiens
uuccugcaggucuggagcuc

SEQ ID NO: 9170 - RNA, 20 nt, Homo sapiens
ccgucacuuuccugcagguc

SEQ ID NO: 9171 - RNA, 20 nt, Homo sapiens
ucuggccgucacuuuccugc

SEQ ID NO: 9172 - RNA, 20 nt, Homo sapiens
ugcucugagccccuuuccuc

SEQ ID NO: 9173 - RNA, 20 nt, Homo sapiens
gcugcagaagugucagcucc

SEQ ID NO: 9174 - RNA, 20 nt, Homo sapiens
ucagcuccagguccacgaug

SEQ ID NO: 9175 - RNA, 20 nt, Homo sapiens
gcuccagguccacgaugcgg

SEQ ID NO: 9176 - RNA, 20 nt, Homo sapiens
ggcccucauagcccugcucc

SEQ ID NO: 9177 - RNA, 20 nt, Homo sapiens
cucauagcccugcuccagga

SEQ ID NO: 9178 - RNA, 20 nt, Homo sapiens
gcuccaggaaggcccucacc

SEQ ID NO: 9179 - RNA, 20 nt, Homo sapiens
ccaggaaggcccucaccugg

SEQ ID NO: 9180 - RNA, 20 nt, Homo sapiens
aggcccucaccuggaggaag

SEQ ID NO: 9181 - RNA, 20 nt, Homo sapiens
aggaaguggagugaguauca

SEQ ID NO: 9182 - RNA, 20 nt, Homo sapiens
ggaaguggagugaguaucac

SEQ ID NO: 9183 - RNA, 20 nt, Homo sapiens
gcagccuuggguaggagugg

SEQ ID NO: 9184 - RNA, 20 nt, Homo sapiens
ugcagccuuggguaggagug

SEQ ID NO: 9185 - RNA, 20 nt, Homo sapiens
cugcagccuuggguaggagu

SEQ ID NO: 9186 - RNA, 20 nt, Homo sapiens
ucugcagccuuggguaggag

SEQ ID NO: 9187 - RNA, 20 nt, Homo sapiens
acacuucugcagccuugggu

SEQ ID NO: 9188 - RNA, 20 nt, Homo sapiens
gcugacacuucugcagccuu

SEQ ID NO: 9189 - RNA, 20 nt, Homo sapiens
agcugacacuucugcagccu

SEQ ID NO: 9190 - RNA, 20 nt, Homo sapiens
gggccuccgcaucguggacc

SEQ ID NO: 9191 - RNA, 20 nt, Homo sapiens
cuaugagggccuccgcaucg

SEQ ID NO: 9192 - RNA, 20 nt, Homo sapiens
uuccuggagcagggcuauga

SEQ ID NO: 9193 - RNA, 20 nt, Homo sapiens
cuuccuggagcagggcuaug

SEQ ID NO: 9194 - RNA, 20 nt, Homo sapiens
gugagggccuuccuggagca

SEQ ID NO: 9195 - RNA, 20 nt, Homo sapiens
ggugagggccuuccuggagc

SEQ ID NO: 9196 - RNA, 20 nt, Homo sapiens
ccuccaggugagggccuucc

SEQ ID NO: 9197 - RNA, 20 nt, Homo sapiens
acuccacuuccuccagguga

SEQ ID NO: 9198 - RNA, 20 nt, Homo sapiens
cacuccacuuccuccaggug

SEQ ID NO: 9199 - RNA, 20 nt, Homo sapiens
auacucacuccacuuccucc

SEQ ID NO: 9200 - RNA, 20 nt, Homo sapiens
gccccccgucucagccucuc

SEQ ID NO: 9201 - RNA, 20 nt, Homo sapiens
ccccccgucucagccucuca

SEQ ID NO: 9202 - RNA, 20 nt, Homo sapiens
cagccucucagggaaccagc

SEQ ID NO: 9203 - RNA, 20 nt, Homo sapiens
gggaaccagcuggaagauga

SEQ ID NO: 9204 - RNA, 20 nt, Homo sapiens
agcuggaagaugaaggcugu

SEQ ID NO: 9205 - RNA, 20 nt, Homo sapiens
agaugaaggcugucggcuga

SEQ ID NO: 9206 - RNA, 20 nt, Homo sapiens
aggcugucggcugauggcag

SEQ ID NO: 9207 - RNA, 20 nt, Homo sapiens
caucccagcugcacaucgcc

SEQ ID NO: 9208 - RNA, 20 nt, Homo sapiens
gcugcacaucgccaggaagc

SEQ ID NO: 9209 - RNA, 20 nt, Homo sapiens
cccugagaggcugagacggg

SEQ ID NO: 9210 - RNA, 20 nt, Homo sapiens
ucccugagaggcugagacgg

SEQ ID NO: 9211 - RNA, 20 nt, Homo sapiens
uucccugagaggcugagacg

SEQ ID NO: 9212 - RNA, 20 nt, Homo sapiens
guucccugagaggcugagac

SEQ ID NO: 9213 - RNA, 20 nt, Homo sapiens
gguucccugagaggcugaga

SEQ ID NO: 9214 - RNA, 20 nt, Homo sapiens
cuuccagcugguucccugag

SEQ ID NO: 9215 - RNA, 20 nt, Homo sapiens
gacagccuucaucuuccagc

SEQ ID NO: 9216 - RNA, 20 nt, Homo sapiens
cuuccuggcgaugugcagcu

SEQ ID NO: 9217 - RNA, 20 nt, Homo sapiens
gcuuccuggcgaugugcagc

SEQ ID NO: 9218 - RNA, 20 nt, Homo sapiens
gacaacucacuccagcuucc

SEQ ID NO: 9219 - RNA, 20 nt, Homo sapiens
cuccacagccucaguaacaa

SEQ ID NO: 9220 - RNA, 20 nt, Homo sapiens
uccacagccucaguaacaac

SEQ ID NO: 9221 - RNA, 20 nt, Homo sapiens
caguaacaacgggcuuucug

SEQ ID NO: 9222 - RNA, 20 nt, Homo sapiens
aacaacgggcuuucuguggc

SEQ ID NO: 9223 - RNA, 20 nt, Homo sapiens
acaacgggcuuucuguggcc

SEQ ID NO: 9224 - RNA, 20 nt, Homo sapiens
caacgggcuuucuguggccg

SEQ ID NO: 9225 - RNA, 20 nt, Homo sapiens
ccggggugcauugugugcug

SEQ ID NO: 9226 - RNA, 20 nt, Homo sapiens
cggggugcauugugugcuga

SEQ ID NO: 9227 - RNA, 20 nt, Homo sapiens
ugagggccgugagugcgugc

SEQ ID NO: 9228 - RNA, 20 nt, Homo sapiens
cgugagugcgugcuggaccc

SEQ ID NO: 9229 - RNA, 20 nt, Homo sapiens
cccuggcagagcugcacauc

SEQ ID NO: 9230 - RNA, 20 nt, Homo sapiens
uggcagagcugcacaucagg

SEQ ID NO: 9231 - RNA, 20 nt, Homo sapiens
ggcagagcugcacaucaggu

SEQ ID NO: 9232 - RNA, 20 nt, Homo sapiens
aggcuguggagagcaggaga

SEQ ID NO: 9233 - RNA, 20 nt, Homo sapiens
uuacugaggcuguggagagc

SEQ ID NO: 9234 - RNA, 20 nt, Homo sapiens
gcccguuguuacugaggcug

SEQ ID NO: 9235 - RNA, 20 nt, Homo sapiens
cagaaagcccguuguuacug

SEQ ID NO: 9236 - RNA, 20 nt, Homo sapiens
ccucagcacacaaugcaccc

SEQ ID NO: 9237 - RNA, 20 nt, Homo sapiens
caggguccagcacgcacuca

SEQ ID NO: 9238 - RNA, 20 nt, Homo sapiens
ccugaugugcagcucugcca

SEQ ID NO: 9239 - RNA, 20 nt, Homo sapiens
accugaugugcagcucugcc

SEQ ID NO: 9240 - RNA, 20 nt, Homo sapiens
ugugaucuucauguuugccc

SEQ ID NO: 9241 - RNA, 20 nt, Homo sapiens
cauguuugcccaggagccag

SEQ ID NO: 9242 - RNA, 20 nt, Homo sapiens
ccaggagccagaggagcaga

SEQ ID NO: 9243 - RNA, 20 nt, Homo sapiens
caggagccagaggagcagaa

SEQ ID NO: 9244 - RNA, 20 nt, Homo sapiens
aggagccagaggagcagaag

SEQ ID NO: 9245 - RNA, 20 nt, Homo sapiens
agaggagcagaaggggcccc

SEQ ID NO: 9246 - RNA, 20 nt, Homo sapiens
agcagaaggggccccaggag

SEQ ID NO: 9247 - RNA, 20 nt, Homo sapiens
gaaggggccccaggagaggu

SEQ ID NO: 9248 - RNA, 20 nt, Homo sapiens
aaggggccccaggagaggua

SEQ ID NO: 9249 - RNA, 20 nt, Homo sapiens
aggcugugaagacaaaagag

SEQ ID NO: 9250 - RNA, 20 nt, Homo sapiens
caggcugugaagacaaaaga

SEQ ID NO: 9251 - RNA, 20 nt, Homo sapiens
gcaggcugugaagacaaaag

SEQ ID NO: 9252 - RNA, 20 nt, Homo sapiens
agaucacaguuuugugcugc

SEQ ID NO: 9253 - RNA, 20 nt, Homo sapiens
cuucugcuccucuggcuccu

SEQ ID NO: 9254 - RNA, 20 nt, Homo sapiens
ccuucugcuccucuggcucc

SEQ ID NO: 9255 - RNA, 20 nt, Homo sapiens
uggggccccuucugcuccuc

SEQ ID NO: 9256 - RNA, 20 nt, Homo sapiens
aucgggcccuaccucuccug

SEQ ID NO: 9257 - RNA, 20 nt, Homo sapiens
aaucgggcccuaccucuccu

SEQ ID NO: 9258 - RNA, 20 nt, Homo sapiens
aaaucgggcccuaccucucc

SEQ ID NO: 9259 - RNA, 20 nt, Homo sapiens
agcugccucugagcucccga

SEQ ID NO: 9260 - RNA, 20 nt, Homo sapiens
cucugagcucccgaaggaug

SEQ ID NO: 9261 - RNA, 20 nt, Homo sapiens
cgaaggaugagguacaguga

SEQ ID NO: 9262 - RNA, 20 nt, Homo sapiens
gcccuggagggacaucacca

SEQ ID NO: 9263 - RNA, 20 nt, Homo sapiens
ucaagaaaugcagcccugga

SEQ ID NO: 9264 - RNA, 20 nt, Homo sapiens
gucaagaaaugcagcccugg

SEQ ID NO: 9265 - RNA, 20 nt, Homo sapiens
gcugucaagaaaugcagccc

SEQ ID NO: 9266 - RNA, 20 nt, Homo sapiens
cagagggcaucuggagcaug

SEQ ID NO: 9267 - RNA, 20 nt, Homo sapiens
gaggcagcucagagggcauc

SEQ ID NO: 9268 - RNA, 20 nt, Homo sapiens
gagcucagaggcagcucaga

SEQ ID NO: 9269 - RNA, 20 nt, Homo sapiens
ggagcucagaggcagcucag

SEQ ID NO: 9270 - RNA, 20 nt, Homo sapiens
cucauccuucgggagcucag

SEQ ID NO: 9271 - RNA, 20 nt, Homo sapiens
aucacuguaccucauccuuc

SEQ ID NO: 9272 - RNA, 20 nt, Homo sapiens
caucacuguaccucauccuu

SEQ ID NO: 9273 - RNA, 20 nt, Homo sapiens
cugggcaggcugacacauug

SEQ ID NO: 9274 - RNA, 20 nt, Homo sapiens
gcaccuagagcagcucugca

SEQ ID NO: 9275 - RNA, 20 nt, Homo sapiens
agagcagcucugcaaggcuc

SEQ ID NO: 9276 - RNA, 20 nt, Homo sapiens
gagcagcucugcaaggcucu

SEQ ID NO: 9277 - RNA, 20 nt, Homo sapiens
cagcucugcaaggcucuggg

SEQ ID NO: 9278 - RNA, 20 nt, Homo sapiens
cugggaggaagcugccaccu

SEQ ID NO: 9279 - RNA, 20 nt, Homo sapiens
ucaccuccaccucgagugag

SEQ ID NO: 9280 - RNA, 20 nt, Homo sapiens
cgagugagugguuugugugu

SEQ ID NO: 9281 - RNA, 20 nt, Homo sapiens
acaaugugucagccugccca

SEQ ID NO: 9282 - RNA, 20 nt, Homo sapiens
cacaaugugucagccugccc

SEQ ID NO: 9283 - RNA, 20 nt, Homo sapiens
gcucuaggugcuuuucuugg

SEQ ID NO: 9284 - RNA, 20 nt, Homo sapiens
gcugcucuaggugcuuuucu

SEQ ID NO: 9285 - RNA, 20 nt, Homo sapiens
gagccuugcagagcugcucu

SEQ ID NO: 9286 - RNA, 20 nt, Homo sapiens
cgagguggaggugaccgagg

SEQ ID NO: 9287 - RNA, 20 nt, Homo sapiens
acucgagguggaggugaccg

SEQ ID NO: 9288 - RNA, 20 nt, Homo sapiens
aaaccacucacucgaggugg

SEQ ID NO: 9289 - RNA, 20 nt, Homo sapiens
cacaaaccacucacucgagg

SEQ ID NO: 9290 - RNA, 20 nt, Homo sapiens
acacacaaaccacucacucg

SEQ ID NO: 9291 - RNA, 20 nt, Homo sapiens
cuccccacccccagcuucuc

SEQ ID NO: 9292 - RNA, 20 nt, Homo sapiens
cagcuucucaggcaaugcuc

SEQ ID NO: 9293 - RNA, 20 nt, Homo sapiens
agcuucucaggcaaugcucu

SEQ ID NO: 9294 - RNA, 20 nt, Homo sapiens
gcuucucaggcaaugcucug

SEQ ID NO: 9295 - RNA, 20 nt, Homo sapiens
cuucucaggcaaugcucugg

SEQ ID NO: 9296 - RNA, 20 nt, Homo sapiens
ggcaaugcucugggggauga

SEQ ID NO: 9297 - RNA, 20 nt, Homo sapiens
ugggggaugaaggugcagcc

SEQ ID NO: 9298 - RNA, 20 nt, Homo sapiens
ggaugaaggugcagcccggc

SEQ ID NO: 9299 - RNA, 20 nt, Homo sapiens
cggcuggcucagcugcuccc

SEQ ID NO: 9300 - RNA, 20 nt, Homo sapiens
ggcuggcucagcugcuccca

SEQ ID NO: 9301 - RNA, 20 nt, Homo sapiens
ggcucagcugcucccagggc

SEQ ID NO: 9302 - RNA, 20 nt, Homo sapiens
gcucagcugcucccagggcu

SEQ ID NO: 9303 - RNA, 20 nt, Homo sapiens
cuugaagugaguagcccgcu

SEQ ID NO: 9304 - RNA, 20 nt, Homo sapiens
gaagcuggggguggggagaa

SEQ ID NO: 9305 - RNA, 20 nt, Homo sapiens
agaagcuggggguggggaga

SEQ ID NO: 9306 - RNA, 20 nt, Homo sapiens
ugccugagaagcugggggug

SEQ ID NO: 9307 - RNA, 20 nt, Homo sapiens
uugccugagaagcugggggu

SEQ ID NO: 9308 - RNA, 20 nt, Homo sapiens
auugccugagaagcuggggg

SEQ ID NO: 9309 - RNA, 20 nt, Homo sapiens
agcauugccugagaagcugg

SEQ ID NO: 9310 - RNA, 20 nt, Homo sapiens
gagcauugccugagaagcug

SEQ ID NO: 9311 - RNA, 20 nt, Homo sapiens
agagcauugccugagaagcu

SEQ ID NO: 9312 - RNA, 20 nt, Homo sapiens
cagagcauugccugagaagc

SEQ ID NO: 9313 - RNA, 20 nt, Homo sapiens
ugggagcagcugagccagcc

SEQ ID NO: 9314 - RNA, 20 nt, Homo sapiens
cugggagcagcugagccagc

SEQ ID NO: 9315 - RNA, 20 nt, Homo sapiens
acugcagagcucccagcccu

SEQ ID NO: 9316 - RNA, 20 nt, Homo sapiens
gacugcagagcucccagccc

SEQ ID NO: 9317 - RNA, 20 nt, Homo sapiens
cuagcgggcuacucacuuca

SEQ ID NO: 9318 - RNA, 20 nt, Homo sapiens
aucuccagccucagugagaa

SEQ ID NO: 9319 - RNA, 20 nt, Homo sapiens
cagugagaacgguuuguccc

SEQ ID NO: 9320 - RNA, 20 nt, Homo sapiens
uuugucccuggaugccgugu

SEQ ID NO: 9321 - RNA, 20 nt, Homo sapiens
uugucccuggaugccguguu

SEQ ID NO: 9322 - RNA, 20 nt, Homo sapiens
ccuggaugccguguuggguu

SEQ ID NO: 9323 - RNA, 20 nt, Homo sapiens
augccguguuggguuugguu

SEQ ID NO: 9324 - RNA, 20 nt, Homo sapiens
ggugcuucuccacucugcag

SEQ ID NO: 9325 - RNA, 20 nt, Homo sapiens
ucugcaguggcucuuccgcu

SEQ ID NO: 9326 - RNA, 20 nt, Homo sapiens
ggcucuuccgcuuggacauc

SEQ ID NO: 9327 - RNA, 20 nt, Homo sapiens
gaggcuggagaucacagggg

SEQ ID NO: 9328 - RNA, 20 nt, Homo sapiens
acugaggcuggagaucacag

SEQ ID NO: 9329 - RNA, 20 nt, Homo sapiens
cacugaggcuggagaucaca

SEQ ID NO: 9330 - RNA, 20 nt, Homo sapiens
ucacugaggcuggagaucac

SEQ ID NO: 9331 - RNA, 20 nt, Homo sapiens
caaaccguucucacugaggc

SEQ ID NO: 9332 - RNA, 20 nt, Homo sapiens
gggacaaaccguucucacug

SEQ ID NO: 9333 - RNA, 20 nt, Homo sapiens
caaacccaacacggcaucca

SEQ ID NO: 9334 - RNA, 20 nt, Homo sapiens
ccaaacccaacacggcaucc

SEQ ID NO: 9335 - RNA, 20 nt, Homo sapiens
gcaccgaaccaaacccaaca

SEQ ID NO: 9336 - RNA, 20 nt, Homo sapiens
gcggaagagccacugcagag

SEQ ID NO: 9337 - RNA, 20 nt, Homo sapiens
acgcucaccugauguccaag

SEQ ID NO: 9338 - RNA, 20 nt, Homo sapiens
agccaacacauccuccugag

SEQ ID NO: 9339 - RNA, 20 nt, Homo sapiens
gccaacacauccuccugaga

SEQ ID NO: 9340 - RNA, 20 nt, Homo sapiens
ccaacacauccuccugagag

SEQ ID NO: 9341 - RNA, 20 nt, Homo sapiens
ugagaggggacaagacaagc

SEQ ID NO: 9342 - RNA, 20 nt, Homo sapiens
ggggacaagacaagcaggug

SEQ ID NO: 9343 - RNA, 20 nt, Homo sapiens
gacaagacaagcaggugagg

SEQ ID NO: 9344 - RNA, 20 nt, Homo sapiens
acaagacaagcaggugagga

SEQ ID NO: 9345 - RNA, 20 nt, Homo sapiens
gcaggugaggagggaacgcu

SEQ ID NO: 9346 - RNA, 20 nt, Homo sapiens
caggugaggagggaacgcuc

SEQ ID NO: 9347 - RNA, 20 nt, Homo sapiens
uuucaaagcuggaagcagag

SEQ ID NO: 9348 - RNA, 20 nt, Homo sapiens
gauguguuggcuuucaaagc

SEQ ID NO: 9349 - RNA, 20 nt, Homo sapiens
ccccucucaggaggaugugu

SEQ ID NO: 9350 - RNA, 20 nt, Homo sapiens
uugucuuguccccucucagg

SEQ ID NO: 9351 - RNA, 20 nt, Homo sapiens
ugcuugucuuguccccucuc

SEQ ID NO: 9352 - RNA, 20 nt, Homo sapiens
aucccccuccuagggauaug

SEQ ID NO: 9353 - RNA, 20 nt, Homo sapiens
ucccccuccuagggauaugu

SEQ ID NO: 9354 - RNA, 20 nt, Homo sapiens
ccuagggauaugugggccac

SEQ ID NO: 9355 - RNA, 20 nt, Homo sapiens
ccagcugcagccaaguucuu

SEQ ID NO: 9356 - RNA, 20 nt, Homo sapiens
cagcugcagccaaguucuua

SEQ ID NO: 9357 - RNA, 20 nt, Homo sapiens
uccgucagcgcugcaucccc

SEQ ID NO: 9358 - RNA, 20 nt, Homo sapiens
gcugcauccccaggagccuc

SEQ ID NO: 9359 - RNA, 20 nt, Homo sapiens
gcccacauaucccuaggagg

SEQ ID NO: 9360 - RNA, 20 nt, Homo sapiens
ggcccacauaucccuaggag

SEQ ID NO: 9361 - RNA, 20 nt, Homo sapiens
uggcccacauaucccuagga

SEQ ID NO: 9362 - RNA, 20 nt, Homo sapiens
guggcccacauaucccuagg

SEQ ID NO: 9363 - RNA, 20 nt, Homo sapiens
ccaguggcccacauaucccu

SEQ ID NO: 9364 - RNA, 20 nt, Homo sapiens
gaagucuggcaaagauccag

SEQ ID NO: 9365 - RNA, 20 nt, Homo sapiens
uuggcugcagcugggaaguc

SEQ ID NO: 9366 - RNA, 20 nt, Homo sapiens
cuaagaacuuggcugcagcu

SEQ ID NO: 9367 - RNA, 20 nt, Homo sapiens
ccuaagaacuuggcugcagc

SEQ ID NO: 9368 - RNA, 20 nt, Homo sapiens
cugacggaacccuaagaacu

SEQ ID NO: 9369 - RNA, 20 nt, Homo sapiens
uccuggggaugcagcgcuga

SEQ ID NO: 9370 - RNA, 20 nt, Homo sapiens
gacaguaccagaggcuccug

SEQ ID NO: 9371 - RNA, 20 nt, Homo sapiens
ggacaguaccagaggcuccu

SEQ ID NO: 9372 - RNA, 20 nt, Homo sapiens
gggacaguaccagaggcucc

SEQ ID NO: 9373 - RNA, 20 nt, Homo sapiens
aagggcugggacaguaccag

SEQ ID NO: 9374 - RNA, 20 nt, Homo sapiens
cagccucagugaguguccuc

SEQ ID NO: 9375 - RNA, 20 nt, Homo sapiens
ccgccucugugccacucuga

SEQ ID NO: 9376 - RNA, 20 nt, Homo sapiens
ugccacucugaaggacugcc

SEQ ID NO: 9377 - RNA, 20 nt, Homo sapiens
gccacucugaaggacugccc

SEQ ID NO: 9378 - RNA, 20 nt, Homo sapiens
gaaggacugcccgggacccc

SEQ ID NO: 9379 - RNA, 20 nt, Homo sapiens
uggaacugcaguaaguaacg

SEQ ID NO: 9380 - RNA, 20 nt, Homo sapiens
ugaggcugcaaaggggcaau

SEQ ID NO: 9381 - RNA, 20 nt, Homo sapiens
cugaggcugcaaaggggcaa

SEQ ID NO: 9382 - RNA, 20 nt, Homo sapiens
cacucacugaggcugcaaag

SEQ ID NO: 9383 - RNA, 20 nt, Homo sapiens
acacucacugaggcugcaaa

SEQ ID NO: 9384 - RNA, 20 nt, Homo sapiens
gacacucacugaggcugcaa

SEQ ID NO: 9385 - RNA, 20 nt, Homo sapiens
gcuccagaggacacucacug

SEQ ID NO: 9386 - RNA, 20 nt, Homo sapiens
gugaggcuugggggcuccag

SEQ ID NO: 9387 - RNA, 20 nt, Homo sapiens
cagaggcgggugaggcuugg

SEQ ID NO: 9388 - RNA, 20 nt, Homo sapiens
acagaggcgggugaggcuug

SEQ ID NO: 9389 - RNA, 20 nt, Homo sapiens
cacagaggcgggugaggcuu

SEQ ID NO: 9390 - RNA, 20 nt, Homo sapiens
gcacagaggcgggugaggcu

SEQ ID NO: 9391 - RNA, 20 nt, Homo sapiens
gaguggcacagaggcgggug

SEQ ID NO: 9392 - RNA, 20 nt, Homo sapiens
cuucagaguggcacagaggc

SEQ ID NO: 9393 - RNA, 20 nt, Homo sapiens
ccuucagaguggcacagagg

SEQ ID NO: 9394 - RNA, 20 nt, Homo sapiens
aguccuucagaguggcacag

SEQ ID NO: 9395 - RNA, 20 nt, Homo sapiens
ucccgggcaguccuucagag

SEQ ID NO: 9396 - RNA, 20 nt, Homo sapiens
acugcaguuccagggguccc

SEQ ID NO: 9397 - RNA, 20 nt, Homo sapiens
uacugcaguuccaggggucc

SEQ ID NO: 9398 - RNA, 20 nt, Homo sapiens
guuacuuacugcaguuccag

SEQ ID NO: 9399 - RNA, 20 nt, Homo sapiens
cguuacuuacugcaguucca

SEQ ID NO: 9400 - RNA, 20 nt, Homo sapiens
ucguuacuuacugcaguucc

SEQ ID NO: 9401 - RNA, 20 nt, Homo sapiens
guuccugagugaccagagcc

SEQ ID NO: 9402 - RNA, 20 nt, Homo sapiens
ccagagccuggagacucuac

SEQ ID NO: 9403 - RNA, 20 nt, Homo sapiens
aaucugugaaacaaagcagg

SEQ ID NO: 9404 - RNA, 20 nt, Homo sapiens
gacaaucugugaaacaaagc

SEQ ID NO: 9405 - RNA, 20 nt, Homo sapiens
cuggucacucaggaacucac

SEQ ID NO: 9406 - RNA, 20 nt, Homo sapiens
ucuccaggcucuggucacuc

SEQ ID NO: 9407 - RNA, 20 nt, Homo sapiens
ccaguagagucuccaggcuc

SEQ ID NO: 9408 - RNA, 20 nt, Homo sapiens
agcaguccaguagagucucc

SEQ ID NO: 9409 - RNA, 20 nt, Homo sapiens
aggcucagcugagggaguug

SEQ ID NO: 9410 - RNA, 20 nt, Homo sapiens
acugcagcaggcucagcuga

SEQ ID NO: 9411 - RNA, 20 nt, Homo sapiens
uacugcagcaggcucagcug

SEQ ID NO: 9412 - RNA, 20 nt, Homo sapiens
aacucucgucuuacugcagc

SEQ ID NO: 9413 - RNA, 20 nt, Homo sapiens
ccuuuucaggcugagccaga

SEQ ID NO: 9414 - RNA, 20 nt, Homo sapiens
cuuuucaggcugagccagac

SEQ ID NO: 9415 - RNA, 20 nt, Homo sapiens
cccgaaaagccccuuccugc

SEQ ID NO: 9416 - RNA, 20 nt, Homo sapiens
acaccuuaagccugugucca

SEQ ID NO: 9417 - RNA, 20 nt, Homo sapiens
caccuuaagccuguguccac

SEQ ID NO: 9418 - RNA, 20 nt, Homo sapiens
ccuguguccacggguuaaaa

SEQ ID NO: 9419 - RNA, 20 nt, Homo sapiens
guguccacggguuaaaaagg

SEQ ID NO: 9420 - RNA, 20 nt, Homo sapiens
ggguuaaaaagguggaucuc

SEQ ID NO: 9421 - RNA, 20 nt, Homo sapiens
uuaaaaagguggaucucagg

SEQ ID NO: 9422 - RNA, 20 nt, Homo sapiens
uaaaaagguggaucucaggu

SEQ ID NO: 9423 - RNA, 20 nt, Homo sapiens
aucucaggugggcauucccc

SEQ ID NO: 9424 - RNA, 20 nt, Homo sapiens
ucucaggugggcauuccccu

SEQ ID NO: 9425 - RNA, 20 nt, Homo sapiens
cucagccugaaaaggaaagg

SEQ ID NO: 9426 - RNA, 20 nt, Homo sapiens
gcucagccugaaaaggaaag

SEQ ID NO: 9427 - RNA, 20 nt, Homo sapiens
ggcucagccugaaaaggaaa

SEQ ID NO: 9428 - RNA, 20 nt, Homo sapiens
uggcucagccugaaaaggaa

SEQ ID NO: 9429 - RNA, 20 nt, Homo sapiens
ccgucuggcucagccugaaa

SEQ ID NO: 9430 - RNA, 20 nt, Homo sapiens
uuuucggggacagucccguc

SEQ ID NO: 9431 - RNA, 20 nt, Homo sapiens
cagcaggaaggggcuuuucg

SEQ ID NO: 9432 - RNA, 20 nt, Homo sapiens
ccagcaggaaggggcuuuuc

SEQ ID NO: 9433 - RNA, 20 nt, Homo sapiens
gccagcaggaaggggcuuuu

SEQ ID NO: 9434 - RNA, 20 nt, Homo sapiens
agguguuggccagcaggaag

SEQ ID NO: 9435 - RNA, 20 nt, Homo sapiens
aagguguuggccagcaggaa

SEQ ID NO: 9436 - RNA, 20 nt, Homo sapiens
uaagguguuggccagcagga

SEQ ID NO: 9437 - RNA, 20 nt, Homo sapiens
ggcuuaagguguuggccagc

SEQ ID NO: 9438 - RNA, 20 nt, Homo sapiens
uggacacaggcuuaaggugu

SEQ ID NO: 9439 - RNA, 20 nt, Homo sapiens
aacccguggacacaggcuua

SEQ ID NO: 9440 - RNA, 20 nt, Homo sapiens
ccuuuuuaacccguggacac

SEQ ID NO: 9441 - RNA, 20 nt, Homo sapiens
agauccaccuuuuuaacccg

SEQ ID NO: 9442 - RNA, 20 nt, Homo sapiens
uuugcacuucagauccaacg

SEQ ID NO: 9443 - RNA, 20 nt, Homo sapiens
gcacuucagauccaacgagg

SEQ ID NO: 9444 - RNA, 20 nt, Homo sapiens
cuucagauccaacgaggagg

SEQ ID NO: 9445 - RNA, 20 nt, Homo sapiens
agauccaacgaggaggagga

SEQ ID NO: 9446 - RNA, 20 nt, Homo sapiens
gaggaggaaggcgugugcug

SEQ ID NO: 9447 - RNA, 20 nt, Homo sapiens
aggaggaaggcgugugcugu

SEQ ID NO: 9448 - RNA, 20 nt, Homo sapiens
gaccuggaucagacaggacc

SEQ ID NO: 9449 - RNA, 20 nt, Homo sapiens
ugcagggaccuggaucagac

SEQ ID NO: 9450 - RNA, 20 nt, Homo sapiens
aguugcauggugcagggacc

SEQ ID NO: 9451 - RNA, 20 nt, Homo sapiens
gugcaaaguugcauggugca

SEQ ID NO: 9452 - RNA, 20 nt, Homo sapiens
agugcaaaguugcauggugc

SEQ ID NO: 9453 - RNA, 20 nt, Homo sapiens
aucugaagugcaaaguugca

SEQ ID NO: 9454 - RNA, 20 nt, Homo sapiens
cacgccuuccuccuccucgu

SEQ ID NO: 9455 - RNA, 20 nt, Homo sapiens
ccccuuuaccuccguccagc

SEQ ID NO: 9456 - RNA, 20 nt, Homo sapiens
ccuccguccagcagguucac

SEQ ID NO: 9457 - RNA, 20 nt, Homo sapiens
cacaggcugcagccucagcc

SEQ ID NO: 9458 - RNA, 20 nt, Homo sapiens
agcacguagagucacucugc

SEQ ID NO: 9459 - RNA, 20 nt, Homo sapiens
ccugcuggacggagguaaag

SEQ ID NO: 9460 - RNA, 20 nt, Homo sapiens
accugcuggacggagguaaa

SEQ ID NO: 9461 - RNA, 20 nt, Homo sapiens
aaccugcuggacggagguaa

SEQ ID NO: 9462 - RNA, 20 nt, Homo sapiens
ccugugaaccugcuggacgg

SEQ ID NO: 9463 - RNA, 20 nt, Homo sapiens
cagccugugaaccugcugga

SEQ ID NO: 9464 - RNA, 20 nt, Homo sapiens
gcugcagccugugaaccugc

SEQ ID NO: 9465 - RNA, 20 nt, Homo sapiens
acucuacgugcuccuggcug

SEQ ID NO: 9466 - RNA, 20 nt, Homo sapiens
agagugacucuacgugcucc

SEQ ID NO: 9467 - RNA, 20 nt, Homo sapiens
guugaaugagguggaggcug

SEQ ID NO: 9468 - RNA, 20 nt, Homo sapiens
gagggaguugaaugaggugg

SEQ ID NO: 9469 - RNA, 20 nt, Homo sapiens
cagucucucagcaaaccugc

SEQ ID NO: 9470 - RNA, 20 nt, Homo sapiens
agucucucagcaaaccugcu

SEQ ID NO: 9471 - RNA, 20 nt, Homo sapiens
gcaaaccugcugggcgacag

SEQ ID NO: 9472 - RNA, 20 nt, Homo sapiens
cagcggacucagaugccuuc

SEQ ID NO: 9473 - RNA, 20 nt, Homo sapiens
ccuucuggaaugucugccgc

SEQ ID NO: 9474 - RNA, 20 nt, Homo sapiens
cugccgcaggugcccaucuc

SEQ ID NO: 9475 - RNA, 20 nt, Homo sapiens
cuccgguuugcuugaguaag

SEQ ID NO: 9476 - RNA, 20 nt, Homo sapiens
cugagagacuguagggggua

SEQ ID NO: 9477 - RNA, 20 nt, Homo sapiens
guuugcugagagacuguagg

SEQ ID NO: 9478 - RNA, 20 nt, Homo sapiens
gguuugcugagagacuguag

SEQ ID NO: 9479 - RNA, 20 nt, Homo sapiens
agguuugcugagagacugua

SEQ ID NO: 9480 - RNA, 20 nt, Homo sapiens
cagguuugcugagagacugu

SEQ ID NO: 9481 - RNA, 20 nt, Homo sapiens
ugaguccgcugucgcccagc

SEQ ID NO: 9482 - RNA, 20 nt, Homo sapiens
ccugcggcagacauuccaga

SEQ ID NO: 9483 - RNA, 20 nt, Homo sapiens
aaaccggagaugggcaccug

SEQ ID NO: 9484 - RNA, 20 nt, Homo sapiens
uacucaagcaaaccggagau

SEQ ID NO: 9485 - RNA, 20 nt, Homo sapiens
uuacucaagcaaaccggaga

SEQ ID NO: 9486 - RNA, 20 nt, Homo sapiens
uuccacuuacucaagcaaac

SEQ ID NO: 9487 - RNA, 20 nt, Homo sapiens
gagucacaacagcauuucuc

SEQ ID NO: 9488 - RNA, 20 nt, Homo sapiens
ggaaagugcccuguaccugc

SEQ ID NO: 9489 - RNA, 20 nt, Homo sapiens
ugcccuccugcccacguguc

SEQ ID NO: 9490 - RNA, 20 nt, Homo sapiens
gcccuccugcccacgugucc

SEQ ID NO: 9491 - RNA, 20 nt, Homo sapiens
cuccugcccacguguccggg

SEQ ID NO: 9492 - RNA, 20 nt, Homo sapiens
cgggaggccucagugaagua

SEQ ID NO: 9493 - RNA, 20 nt, Homo sapiens
gggaggccucagugaaguaa

SEQ ID NO: 9494 - RNA, 20 nt, Homo sapiens
ggaggccucagugaaguaag

SEQ ID NO: 9495 - RNA, 20 nt, Homo sapiens
ucagugaaguaaggggaugu

SEQ ID NO: 9496 - RNA, 20 nt, Homo sapiens
gacucagacuagaagggaaa

SEQ ID NO: 9497 - RNA, 20 nt, Homo sapiens
uguugugacucagacuagaa

SEQ ID NO: 9498 - RNA, 20 nt, Homo sapiens
cuguugugacucagacuaga

SEQ ID NO: 9499 - RNA, 20 nt, Homo sapiens
cagugucuccagcagguaca

SEQ ID NO: 9500 - RNA, 20 nt, Homo sapiens
gcagugucuccagcagguac

SEQ ID NO: 9501 - RNA, 20 nt, Homo sapiens
aggagggcagugucuccagc

SEQ ID NO: 9502 - RNA, 20 nt, Homo sapiens
ucccggacacgugggcagga

SEQ ID NO: 9503 - RNA, 20 nt, Homo sapiens
cucccggacacgugggcagg

SEQ ID NO: 9504 - RNA, 20 nt, Homo sapiens
ggccucccggacacgugggc

SEQ ID NO: 9505 - RNA, 20 nt, Homo sapiens
cugaggccucccggacacgu

SEQ ID NO: 9506 - RNA, 20 nt, Homo sapiens
acugaggccucccggacacg

SEQ ID NO: 9507 - RNA, 20 nt, Homo sapiens
cuuacuucacugaggccucc

SEQ ID NO: 9508 - RNA, 20 nt, Homo sapiens
aacauccccuuacuucacug

SEQ ID NO: 9509 - RNA, 20 nt, Homo sapiens
aggcccuucucucugcagcc

SEQ ID NO: 9510 - RNA, 20 nt, Homo sapiens
ggcccuucucucugcagccu

SEQ ID NO: 9511 - RNA, 20 nt, Homo sapiens
ugggcucugagcagagcuuc

SEQ ID NO: 9512 - RNA, 20 nt, Homo sapiens
ccggauucacuucuccagag

SEQ ID NO: 9513 - RNA, 20 nt, Homo sapiens
ucacuucuccagagaggacc

SEQ ID NO: 9514 - RNA, 20 nt, Homo sapiens
uucuccagagaggaccaggc

SEQ ID NO: 9515 - RNA, 20 nt, Homo sapiens
ucuccagagaggaccaggcu

SEQ ID NO: 9516 - RNA, 20 nt, Homo sapiens
accaggcugggaagacacuc

SEQ ID NO: 9517 - RNA, 20 nt, Homo sapiens
gacacucagguaaucccugc

SEQ ID NO: 9518 - RNA, 20 nt, Homo sapiens
acacucagguaaucccugca

SEQ ID NO: 9519 - RNA, 20 nt, Homo sapiens
aggcugcagagagaagggcc

SEQ ID NO: 9520 - RNA, 20 nt, Homo sapiens
agcccaggcugcagagagaa

SEQ ID NO: 9521 - RNA, 20 nt, Homo sapiens
gagcccaggcugcagagaga

SEQ ID NO: 9522 - RNA, 20 nt, Homo sapiens
ggaagcucugcucagagccc

SEQ ID NO: 9523 - RNA, 20 nt, Homo sapiens
ccucucuggagaagugaauc

SEQ ID NO: 9524 - RNA, 20 nt, Homo sapiens
cuucccagccugguccucuc

SEQ ID NO: 9525 - RNA, 20 nt, Homo sapiens
accugagugucuucccagcc

SEQ ID NO: 9526 - RNA, 20 nt, Homo sapiens
ggcuaagugagugcagcuuc

SEQ ID NO: 9527 - RNA, 20 nt, Homo sapiens
uccggccagagcacgugucc

SEQ ID NO: 9528 - RNA, 20 nt, Homo sapiens
gccagagcacguguccaggc

SEQ ID NO: 9529 - RNA, 20 nt, Homo sapiens
cacguguccaggcuggccac

SEQ ID NO: 9530 - RNA, 20 nt, Homo sapiens
gagcaagucccugcagcuga

SEQ ID NO: 9531 - RNA, 20 nt, Homo sapiens
agccugagggcagaaagcca

SEQ ID NO: 9532 - RNA, 20 nt, Homo sapiens
uagccugagggcagaaagcc

SEQ ID NO: 9533 - RNA, 20 nt, Homo sapiens
gcugcacucacuuagccuga

SEQ ID NO: 9534 - RNA, 20 nt, Homo sapiens
agcugcacucacuuagccug

SEQ ID NO: 9535 - RNA, 20 nt, Homo sapiens
gccuggacacgugcucuggc

SEQ ID NO: 9536 - RNA, 20 nt, Homo sapiens
gccagccuggacacgugcuc

SEQ ID NO: 9537 - RNA, 20 nt, Homo sapiens
gcucaagccgguggccagcc

SEQ ID NO: 9538 - RNA, 20 nt, Homo sapiens
cagggacuugcucaagccgg

SEQ ID NO: 9539 - RNA, 20 nt, Homo sapiens
cugcagggacuugcucaagc

SEQ ID NO: 9540 - RNA, 20 nt, Homo sapiens
cgugagcuccgucagcugca

SEQ ID NO: 9541 - RNA, 20 nt, Homo sapiens
acgugagcuccgucagcugc

SEQ ID NO: 9542 - RNA, 20 nt, Homo sapiens
caggcugacccagugcugcc

SEQ ID NO: 9543 - RNA, 20 nt, Homo sapiens
aggcugacccagugcugccu

SEQ ID NO: 9544 - RNA, 20 nt, Homo sapiens
cugccugggccagaagcagc

SEQ ID NO: 9545 - RNA, 20 nt, Homo sapiens
gcuggccauccuccugagcu

SEQ ID NO: 9546 - RNA, 20 nt, Homo sapiens
ggccauccuccugagcuugg

SEQ ID NO: 9547 - RNA, 20 nt, Homo sapiens
gccauccuccugagcuuggu

SEQ ID NO: 9548 - RNA, 20 nt, Homo sapiens
ccauccuccugagcuuggug

SEQ ID NO: 9549 - RNA, 20 nt, Homo sapiens
agcuugguggggcgacccgc

SEQ ID NO: 9550 - RNA, 20 nt, Homo sapiens
gcuugguggggcgacccgca

SEQ ID NO: 9551 - RNA, 20 nt, Homo sapiens
ccgcagggcuguucagccuc

SEQ ID NO: 9552 - RNA, 20 nt, Homo sapiens
cugggucagccuggagacag

SEQ ID NO: 9553 - RNA, 20 nt, Homo sapiens
caggcagcacugggucagcc

SEQ ID NO: 9554 - RNA, 20 nt, Homo sapiens
cuucuggcccaggcagcacu

SEQ ID NO: 9555 - RNA, 20 nt, Homo sapiens
gcuucuggcccaggcagcac

SEQ ID NO: 9556 - RNA, 20 nt, Homo sapiens
uggccagcugcuucuggccc

SEQ ID NO: 9557 - RNA, 20 nt, Homo sapiens
ggaggauggccagcugcuuc

SEQ ID NO: 9558 - RNA, 20 nt, Homo sapiens
ccccaccaagcucaggagga

SEQ ID NO: 9559 - RNA, 20 nt, Homo sapiens
gucgccccaccaagcucagg

SEQ ID NO: 9560 - RNA, 20 nt, Homo sapiens
cgggucgccccaccaagcuc

SEQ ID NO: 9561 - RNA, 20 nt, Homo sapiens
cugaggcugaacagcccugc

SEQ ID NO: 9562 - RNA, 20 nt, Homo sapiens
ccugaggcugaacagcccug

SEQ ID NO: 9563 - RNA, 20 nt, Homo sapiens
agcgggggaggagguaccug

SEQ ID NO: 9564 - RNA, 20 nt, Homo sapiens
ccccuucugugacagggugc

SEQ ID NO: 9565 - RNA, 20 nt, Homo sapiens
gugacagggugcaggagccg

SEQ ID NO: 9566 - RNA, 20 nt, Homo sapiens
ugacagggugcaggagccgu

SEQ ID NO: 9567 - RNA, 20 nt, Homo sapiens
cagggugcaggagccguggg

SEQ ID NO: 9568 - RNA, 20 nt, Homo sapiens
agccgugggcggacagagcc

SEQ ID NO: 9569 - RNA, 20 nt, Homo sapiens
gccgugggcggacagagcca

SEQ ID NO: 9570 - RNA, 20 nt, Homo sapiens
ccuguuagaagucugcgccc

SEQ ID NO: 9571 - RNA, 20 nt, Homo sapiens
gaagucugcgcccaggccuc

SEQ ID NO: 9572 - RNA, 20 nt, Homo sapiens
caggcagugucacugaaauc

SEQ ID NO: 9573 - RNA, 20 nt, Homo sapiens
aucaggugaguccagagaag

SEQ ID NO: 9574 - RNA, 20 nt, Homo sapiens
ccugcacccugucacagaag

SEQ ID NO: 9575 - RNA, 20 nt, Homo sapiens
uccugcacccugucacagaa

SEQ ID NO: 9576 - RNA, 20 nt, Homo sapiens
cuccugcacccugucacaga

SEQ ID NO: 9577 - RNA, 20 nt, Homo sapiens
acccuggcucuguccgccca

SEQ ID NO: 9578 - RNA, 20 nt, Homo sapiens
uucuaacagggagagaaccc

SEQ ID NO: 9579 - RNA, 20 nt, Homo sapiens
cugggcgcagacuucuaaca

SEQ ID NO: 9580 - RNA, 20 nt, Homo sapiens
ccugggcgcagacuucuaac

SEQ ID NO: 9581 - RNA, 20 nt, Homo sapiens
agugacacugccugaggccu

SEQ ID NO: 9582 - RNA, 20 nt, Homo sapiens
cagugacacugccugaggcc

SEQ ID NO: 9583 - RNA, 20 nt, Homo sapiens
gauuucagugacacugccug

SEQ ID NO: 9584 - RNA, 20 nt, Homo sapiens
gcagcagcucuguguccagc

SEQ ID NO: 9585 - RNA, 20 nt, Homo sapiens
ccagcuggaauuuccucgcc

SEQ ID NO: 9586 - RNA, 20 nt, Homo sapiens
ggaagagaauccagaagcug

SEQ ID NO: 9587 - RNA, 20 nt, Homo sapiens
auccagaagcuguggcacuc

SEQ ID NO: 9588 - RNA, 20 nt, Homo sapiens
cagaagcuguggcacucagg

SEQ ID NO: 9589 - RNA, 20 nt, Homo sapiens
agaagcuguggcacucaggu

SEQ ID NO: 9590 - RNA, 20 nt, Homo sapiens
cucaggugggacccagcacc

SEQ ID NO: 9591 - RNA, 20 nt, Homo sapiens
ucaggugggacccagcacca

SEQ ID NO: 9592 - RNA, 20 nt, Homo sapiens
gcugggucucggagaugcug

SEQ ID NO: 9593 - RNA, 20 nt, Homo sapiens
acagagcugcugcugggucu

SEQ ID NO: 9594 - RNA, 20 nt, Homo sapiens
cuggacacagagcugcugcu

SEQ ID NO: 9595 - RNA, 20 nt, Homo sapiens
gcuggacacagagcugcugc

SEQ ID NO: 9596 - RNA, 20 nt, Homo sapiens
ccuggcgaggaaauuccagc

SEQ ID NO: 9597 - RNA, 20 nt, Homo sapiens
ucuggauucucuuccuggcg

SEQ ID NO: 9598 - RNA, 20 nt, Homo sapiens
cagcuucuggauucucuucc

SEQ ID NO: 9599 - RNA, 20 nt, Homo sapiens
caccugagugccacagcuuc

SEQ ID NO: 9600 - RNA, 20 nt, Homo sapiens
cucccugucuguguccaggu

SEQ ID NO: 9601 - RNA, 20 nt, Homo sapiens
agguuggcucacugugaccu

SEQ ID NO: 9602 - RNA, 20 nt, Homo sapiens
gcccaccacagccuucuugu

SEQ ID NO: 9603 - RNA, 20 nt, Homo sapiens
cccaccacagccuucuuguc

SEQ ID NO: 9604 - RNA, 20 nt, Homo sapiens
ccuucuugucgggcagcuga

SEQ ID NO: 9605 - RNA, 20 nt, Homo sapiens
agcugauggagacaugugcc

SEQ ID NO: 9606 - RNA, 20 nt, Homo sapiens
gugccaggcugcagcagcuc

SEQ ID NO: 9607 - RNA, 20 nt, Homo sapiens
cagcagcucaggucagcgcc

SEQ ID NO: 9608 - RNA, 20 nt, Homo sapiens
agccaaccuggacacagaca

SEQ ID NO: 9609 - RNA, 20 nt, Homo sapiens
gagccaaccuggacacagac

SEQ ID NO: 9610 - RNA, 20 nt, Homo sapiens
aaggucacagugagccaacc

SEQ ID NO: 9611 - RNA, 20 nt, Homo sapiens
gaaggcuguggugggcucca

SEQ ID NO: 9612 - RNA, 20 nt, Homo sapiens
cccgacaagaaggcuguggu

SEQ ID NO: 9613 - RNA, 20 nt, Homo sapiens
gcccgacaagaaggcugugg

SEQ ID NO: 9614 - RNA, 20 nt, Homo sapiens
gcugcccgacaagaaggcug

SEQ ID NO: 9615 - RNA, 20 nt, Homo sapiens
ccaucagcugcccgacaaga

SEQ ID NO: 9616 - RNA, 20 nt, Homo sapiens
ugaccugagcugcugcagcc

SEQ ID NO: 9617 - RNA, 20 nt, Homo sapiens
ggaccuuuucagcuugucuc

SEQ ID NO: 9618 - RNA, 20 nt, Homo sapiens
gucucagguuaaccucugug

SEQ ID NO: 9619 - RNA, 20 nt, Homo sapiens
ucucugagcugaagacauuu

SEQ ID NO: 9620 - RNA, 20 nt, Homo sapiens
agacaagcugaaaaggucca

SEQ ID NO: 9621 - RNA, 20 nt, Homo sapiens
uaaccugagacaagcugaaa

SEQ ID NO: 9622 - RNA, 20 nt, Homo sapiens
uggcaucaucguccucacag

SEQ ID NO: 9623 - RNA, 20 nt, Homo sapiens
gcucugcagcagcagggaac

SEQ ID NO: 9624 - RNA, 20 nt, Homo sapiens
caggaggcucugcagcagca

SEQ ID NO: 9625 - RNA, 20 nt, Homo sapiens
gcaggaggcucugcagcagc

SEQ ID NO: 9626 - RNA, 20 nt, Homo sapiens
gcucagagagggacagcagg

SEQ ID NO: 9627 - RNA, 20 nt, Homo sapiens
ucagcucagagagggacagc

SEQ ID NO: 9628 - RNA, 20 nt, Homo sapiens
aaaugucuucagcucagaga

SEQ ID NO: 9629 - RNA, 20 nt, Homo sapiens
gaaaugucuucagcucagag

SEQ ID NO: 9630 - RNA, 20 nt, Homo sapiens
cuccagcugugugagcaccg

SEQ ID NO: 9631 - RNA, 20 nt, Homo sapiens
uccagcugugugagcaccga

SEQ ID NO: 9632 - RNA, 20 nt, Homo sapiens
caccgagggccucgcccacc

SEQ ID NO: 9633 - RNA, 20 nt, Homo sapiens
ggccucgcccaccuggcauc

SEQ ID NO: 9634 - RNA, 20 nt, Homo sapiens
cgcccaccuggcaucugguc

SEQ ID NO: 9635 - RNA, 20 nt, Homo sapiens
gcccaccuggcaucuggucu

SEQ ID NO: 9636 - RNA, 20 nt, Homo sapiens
ucugggccacugccaccacu

SEQ ID NO: 9637 - RNA, 20 nt, Homo sapiens
gggccacugccaccacuugg

SEQ ID NO: 9638 - RNA, 20 nt, Homo sapiens
cugccaccacuuggaggagc

SEQ ID NO: 9639 - RNA, 20 nt, Homo sapiens
agcuggagugaguugcagag

SEQ ID NO: 9640 - RNA, 20 nt, Homo sapiens
uggagugaguugcagagugg

SEQ ID NO: 9641 - RNA, 20 nt, Homo sapiens
ggagugaguugcagagugga

SEQ ID NO: 9642 - RNA, 20 nt, Homo sapiens
ucagccuggugggggucaaa

SEQ ID NO: 9643 - RNA, 20 nt, Homo sapiens
gucagccuggugggggucaa

SEQ ID NO: 9644 - RNA, 20 nt, Homo sapiens
gcuggaggucagccuggugg

SEQ ID NO: 9645 - RNA, 20 nt, Homo sapiens
agcuggaggucagccuggug

SEQ ID NO: 9646 - RNA, 20 nt, Homo sapiens
cagcuggaggucagccuggu

SEQ ID NO: 9647 - RNA, 20 nt, Homo sapiens
acagcuggaggucagccugg

SEQ ID NO: 9648 - RNA, 20 nt, Homo sapiens
cacacagcuggaggucagcc

SEQ ID NO: 9649 - RNA, 20 nt, Homo sapiens
cucggugcucacacagcugg

SEQ ID NO: 9650 - RNA, 20 nt, Homo sapiens
gcccucggugcucacacagc

SEQ ID NO: 9651 - RNA, 20 nt, Homo sapiens
ugccaggugggcgaggcccu

SEQ ID NO: 9652 - RNA, 20 nt, Homo sapiens
gaccagaugccaggugggcg

SEQ ID NO: 9653 - RNA, 20 nt, Homo sapiens
gcccagaccagaugccaggu

SEQ ID NO: 9654 - RNA, 20 nt, Homo sapiens
ggcccagaccagaugccagg

SEQ ID NO: 9655 - RNA, 20 nt, Homo sapiens
aguggcccagaccagaugcc

SEQ ID NO: 9656 - RNA, 20 nt, Homo sapiens
gcuccuccaagugguggcag

SEQ ID NO: 9657 - RNA, 20 nt, Homo sapiens
acuccagcuccuccaagugg

SEQ ID NO: 9658 - RNA, 20 nt, Homo sapiens
cucacuccagcuccuccaag

SEQ ID NO: 9659 - RNA, 20 nt, Homo sapiens
gucuaacaaucaauuugaug

SEQ ID NO: 9660 - RNA, 20 nt, Homo sapiens
uaacaaucaauuugaugagg

SEQ ID NO: 9661 - RNA, 20 nt, Homo sapiens
aacaaucaauuugaugagga

SEQ ID NO: 9662 - RNA, 20 nt, Homo sapiens
auuugaugaggagggcacca

SEQ ID NO: 9663 - RNA, 20 nt, Homo sapiens
agggcaccaaggcgcugaug

SEQ ID NO: 9664 - RNA, 20 nt, Homo sapiens
gggcaccaaggcgcugauga

SEQ ID NO: 9665 - RNA, 20 nt, Homo sapiens
ggcgcugaugagggcccuug

SEQ ID NO: 9666 - RNA, 20 nt, Homo sapiens
gcgcugaugagggcccuuga

SEQ ID NO: 9667 - RNA, 20 nt, Homo sapiens
cgcugaugagggcccuugag

SEQ ID NO: 9668 - RNA, 20 nt, Homo sapiens
ugagggcccuugaggggaaa

SEQ ID NO: 9669 - RNA, 20 nt, Homo sapiens
aggggaaauggaugcuaaag

SEQ ID NO: 9670 - RNA, 20 nt, Homo sapiens
gaaauggaugcuaaagaggc

SEQ ID NO: 9671 - RNA, 20 nt, Homo sapiens
gaggcuggaguaaguaguga

SEQ ID NO: 9672 - RNA, 20 nt, Homo sapiens
gcuggaguaaguagugaugg

SEQ ID NO: 9673 - RNA, 20 nt, Homo sapiens
uagacaagcugcagaagacc

SEQ ID NO: 9674 - RNA, 20 nt, Homo sapiens
aagggcccucaucagcgccu

SEQ ID NO: 9675 - RNA, 20 nt, Homo sapiens
uagcauccauuuccccucaa

SEQ ID NO: 9676 - RNA, 20 nt, Homo sapiens
uuagcauccauuuccccuca

SEQ ID NO: 9677 - RNA, 20 nt, Homo sapiens
ucugcugaacagcuccaccu

SEQ ID NO: 9678 - RNA, 20 nt, Homo sapiens
ugaccugccugcagagccuc

SEQ ID NO: 9679 - RNA, 20 nt, Homo sapiens
gccucaggugagugaccgag

SEQ ID NO: 9680 - RNA, 20 nt, Homo sapiens
aggcuggagaagaggaggcc

SEQ ID NO: 9681 - RNA, 20 nt, Homo sapiens
gacugaggcuggagaagagg

SEQ ID NO: 9682 - RNA, 20 nt, Homo sapiens
ggugacugaggcuggagaag

SEQ ID NO: 9683 - RNA, 20 nt, Homo sapiens
cagcagaaggugacugaggc

SEQ ID NO: 9684 - RNA, 20 nt, Homo sapiens
uguucagcagaaggugacug

SEQ ID NO: 9685 - RNA, 20 nt, Homo sapiens
agguggagcuguucagcaga

SEQ ID NO: 9686 - RNA, 20 nt, Homo sapiens
gugaguaagcaaggccaagg

SEQ ID NO: 9687 - RNA, 20 nt, Homo sapiens
ucugugaguaagcaaggcca

SEQ ID NO: 9688 - RNA, 20 nt, Homo sapiens
gcuuagucugugaguaagca

SEQ ID NO: 9689 - RNA, 20 nt, Homo sapiens
ggcucugcaggcaggucauc

SEQ ID NO: 9690 - RNA, 20 nt, Homo sapiens
ucaccugaggcucugcaggc

SEQ ID NO: 9691 - RNA, 20 nt, Homo sapiens
ucacucaccugaggcucugc

SEQ ID NO: 9692 - RNA, 20 nt, Homo sapiens
gccgcucggucacucaccug

SEQ ID NO: 9693 - RNA, 20 nt, Homo sapiens
ccugcuuuuccagacugaac

SEQ ID NO: 9694 - RNA, 20 nt, Homo sapiens
agacugaacaggaacaguau

SEQ ID NO: 9695 - RNA, 20 nt, Homo sapiens
aggaacaguaucggugaugu

SEQ ID NO: 9696 - RNA, 20 nt, Homo sapiens
cgguugcugccaccuuucug

SEQ ID NO: 9697 - RNA, 20 nt, Homo sapiens
gccaccuuucugaggcucuc

SEQ ID NO: 9698 - RNA, 20 nt, Homo sapiens
ccaccuuucugaggcucuca

SEQ ID NO: 9699 - RNA, 20 nt, Homo sapiens
cagggcugccaccagccuag

SEQ ID NO: 9700 - RNA, 20 nt, Homo sapiens
ugccaccagccuagaggagc

SEQ ID NO: 9701 - RNA, 20 nt, Homo sapiens
cuguucagucuggaaaagca

SEQ ID NO: 9702 - RNA, 20 nt, Homo sapiens
ccuguucagucuggaaaagc

SEQ ID NO: 9703 - RNA, 20 nt, Homo sapiens
gauacuguuccuguucaguc

SEQ ID NO: 9704 - RNA, 20 nt, Homo sapiens
cccugagagccucagaaagg

SEQ ID NO: 9705 - RNA, 20 nt, Homo sapiens
cagcccugagagccucagaa

SEQ ID NO: 9706 - RNA, 20 nt, Homo sapiens
cuccagcuccucuaggcugg

SEQ ID NO: 9707 - RNA, 20 nt, Homo sapiens
ucacuccagcuccucuaggc

SEQ ID NO: 9708 - RNA, 20 nt, Homo sapiens
caacucacuccagcuccucu

SEQ ID NO: 9709 - RNA, 20 nt, Homo sapiens
agcuugagccacaaccagau

SEQ ID NO: 9710 - RNA, 20 nt, Homo sapiens
cacaaccagauuggagacgc

SEQ ID NO: 9711 - RNA, 20 nt, Homo sapiens
cacuuagcuaccauccugcc

SEQ ID NO: 9712 - RNA, 20 nt, Homo sapiens
acuuagcuaccauccugccu

SEQ ID NO: 9713 - RNA, 20 nt, Homo sapiens
ugccugggcugccagagcuc

SEQ ID NO: 9714 - RNA, 20 nt, Homo sapiens
ugguuguggcucaagcuugg

SEQ ID NO: 9715 - RNA, 20 nt, Homo sapiens
cugguuguggcucaagcuug

SEQ ID NO: 9716 - RNA, 20 nt, Homo sapiens
ucugguuguggcucaagcuu

SEQ ID NO: 9717 - RNA, 20 nt, Homo sapiens
aucugguuguggcucaagcu

SEQ ID NO: 9718 - RNA, 20 nt, Homo sapiens
cagcgucuccaaucugguug

SEQ ID NO: 9719 - RNA, 20 nt, Homo sapiens
ggacaccagcgucuccaauc

SEQ ID NO: 9720 - RNA, 20 nt, Homo sapiens
gcaggaugguagcuaagugc

SEQ ID NO: 9721 - RNA, 20 nt, Homo sapiens
cucuggcagcccaggcagga

SEQ ID NO: 9722 - RNA, 20 nt, Homo sapiens
ugagcucuggcagcccaggc

SEQ ID NO: 9723 - RNA, 20 nt, Homo sapiens
uuccugagcucuggcagccc

SEQ ID NO: 9724 - RNA, 20 nt, Homo sapiens
cacucuaucuuccugagcuc

SEQ ID NO: 9725 - RNA, 20 nt, Homo sapiens
ccccccucccacagccucuc

SEQ ID NO: 9726 - RNA, 20 nt, Homo sapiens
cccccucccacagccucuca

SEQ ID NO: 9727 - RNA, 20 nt, Homo sapiens
gggaauagcaucagcucagc

SEQ ID NO: 9728 - RNA, 20 nt, Homo sapiens
ggaauagcaucagcucagcc

SEQ ID NO: 9729 - RNA, 20 nt, Homo sapiens
gaauagcaucagcucagccg

SEQ ID NO: 9730 - RNA, 20 nt, Homo sapiens
aauagcaucagcucagccgg

SEQ ID NO: 9731 - RNA, 20 nt, Homo sapiens
cucagccgggggagugcagu

SEQ ID NO: 9732 - RNA, 20 nt, Homo sapiens
cagagucucucguucuuugc

SEQ ID NO: 9733 - RNA, 20 nt, Homo sapiens
ucucguucuuugcaggcgcc

SEQ ID NO: 9734 - RNA, 20 nt, Homo sapiens
cguucuuugcaggcgccugg

SEQ ID NO: 9735 - RNA, 20 nt, Homo sapiens
guugaugugagugucugccc

SEQ ID NO: 9736 - RNA, 20 nt, Homo sapiens
gaugugagugucugcccagg

SEQ ID NO: 9737 - RNA, 20 nt, Homo sapiens
ccugagaggcugugggaggg

SEQ ID NO: 9738 - RNA, 20 nt, Homo sapiens
cccugagaggcugugggagg

SEQ ID NO: 9739 - RNA, 20 nt, Homo sapiens
ucccugagaggcugugggag

SEQ ID NO: 9740 - RNA, 20 nt, Homo sapiens
uucccugagaggcuguggga

SEQ ID NO: 9741 - RNA, 20 nt, Homo sapiens
auucccugagaggcuguggg

SEQ ID NO: 9742 - RNA, 20 nt, Homo sapiens
gcuauucccugagaggcugu

SEQ ID NO: 9743 - RNA, 20 nt, Homo sapiens
ugcuauucccugagaggcug

SEQ ID NO: 9744 - RNA, 20 nt, Homo sapiens
agcugaugcuauucccugag

SEQ ID NO: 9745 - RNA, 20 nt, Homo sapiens
cucugccaacugcacucccc

SEQ ID NO: 9746 - RNA, 20 nt, Homo sapiens
acacucacaucaacuccucc

SEQ ID NO: 9747 - RNA, 20 nt, Homo sapiens
uuccucuccucuuccaggcu

SEQ ID NO: 9748 - RNA, 20 nt, Homo sapiens
caggcuuggcugcaaugccc

SEQ ID NO: 9749 - RNA, 20 nt, Homo sapiens
aggcuuggcugcaaugcccu

SEQ ID NO: 9750 - RNA, 20 nt, Homo sapiens
ggcuuggcugcaaugcccug

SEQ ID NO: 9751 - RNA, 20 nt, Homo sapiens
gcuuggcugcaaugcccugg

SEQ ID NO: 9752 - RNA, 20 nt, Homo sapiens
ccugggggaucccacagccc

SEQ ID NO: 9753 - RNA, 20 nt, Homo sapiens
cugggggaucccacagcccu

SEQ ID NO: 9754 - RNA, 20 nt, Homo sapiens
ugggggaucccacagcccug

SEQ ID NO: 9755 - RNA, 20 nt, Homo sapiens
ggaucccacagcccuggggc

SEQ ID NO: 9756 - RNA, 20 nt, Homo sapiens
cacagcccuggggcuggcuc

SEQ ID NO: 9757 - RNA, 20 nt, Homo sapiens
aggagcugccccagcaccug

SEQ ID NO: 9758 - RNA, 20 nt, Homo sapiens
ggagcugccccagcaccuga

SEQ ID NO: 9759 - RNA, 20 nt, Homo sapiens
ccugaggguccuacagugag

SEQ ID NO: 9760 - RNA, 20 nt, Homo sapiens
agccaagccuggaagaggag

SEQ ID NO: 9761 - RNA, 20 nt, Homo sapiens
auugcagccaagccuggaag

SEQ ID NO: 9762 - RNA, 20 nt, Homo sapiens
cagggcauugcagccaagcc

SEQ ID NO: 9763 - RNA, 20 nt, Homo sapiens
cagggcugugggauccccca

SEQ ID NO: 9764 - RNA, 20 nt, Homo sapiens
ccagggcugugggauccccc

SEQ ID NO: 9765 - RNA, 20 nt, Homo sapiens
ugagccagccccagggcugu

SEQ ID NO: 9766 - RNA, 20 nt, Homo sapiens
cugagccagccccagggcug

SEQ ID NO: 9767 - RNA, 20 nt, Homo sapiens
cagcuccugagccagcccca

SEQ ID NO: 9768 - RNA, 20 nt, Homo sapiens
gcagcuccugagccagcccc

SEQ ID NO: 9769 - RNA, 20 nt, Homo sapiens
uguaggacccucaggugcug

SEQ ID NO: 9770 - RNA, 20 nt, Homo sapiens
cuguaggacccucaggugcu

SEQ ID NO: 9771 - RNA, 20 nt, Homo sapiens
acuguaggacccucaggugc

SEQ ID NO: 9772 - RNA, 20 nt, Homo sapiens
ccacucacuguaggacccuc

SEQ ID NO: 9773 - RNA, 20 nt, Homo sapiens
ggcagggggccacucacugu

SEQ ID NO: 9774 - RNA, 20 nt, Homo sapiens
cagccuaccauucagccauc

SEQ ID NO: 9775 - RNA, 20 nt, Homo sapiens
agccuaccauucagccaucu

SEQ ID NO: 9776 - RNA, 20 nt, Homo sapiens
ccauucagccaucugggccc

SEQ ID NO: 9777 - RNA, 20 nt, Homo sapiens
uucagccaucugggcccagg

SEQ ID NO: 9778 - RNA, 20 nt, Homo sapiens
ucagccaucugggcccaggu

SEQ ID NO: 9779 - RNA, 20 nt, Homo sapiens
cagccaucugggcccaggug

SEQ ID NO: 9780 - RNA, 20 nt, Homo sapiens
cccagguggggcccugagcc

SEQ ID NO: 9781 - RNA, 20 nt, Homo sapiens
uggggcccugagccuggccc

SEQ ID NO: 9782 - RNA, 20 nt, Homo sapiens
ccugagccuggcccaggccc

SEQ ID NO: 9783 - RNA, 20 nt, Homo sapiens
agccuggcccaggcccugga

SEQ ID NO: 9784 - RNA, 20 nt, Homo sapiens
ccuggauggauccccccauu

SEQ ID NO: 9785 - RNA, 20 nt, Homo sapiens
ccccccauuuggaagagauc

SEQ ID NO: 9786 - RNA, 20 nt, Homo sapiens
uuggaagagaucagguaagu

SEQ ID NO: 9787 - RNA, 20 nt, Homo sapiens
uggaagagaucagguaagua

SEQ ID NO: 9788 - RNA, 20 nt, Homo sapiens
ggaagagaucagguaaguag

SEQ ID NO: 9789 - RNA, 20 nt, Homo sapiens
uaggcuggggaaagaggaga

SEQ ID NO: 9790 - RNA, 20 nt, Homo sapiens
guaggcuggggaaagaggag

SEQ ID NO: 9791 - RNA, 20 nt, Homo sapiens
gaaugguaggcuggggaaag

SEQ ID NO: 9792 - RNA, 20 nt, Homo sapiens
gauggcugaaugguaggcug

SEQ ID NO: 9793 - RNA, 20 nt, Homo sapiens
agauggcugaaugguaggcu

SEQ ID NO: 9794 - RNA, 20 nt, Homo sapiens
cagauggcugaaugguaggc

SEQ ID NO: 9795 - RNA, 20 nt, Homo sapiens
ggcccagauggcugaauggu

SEQ ID NO: 9796 - RNA, 20 nt, Homo sapiens
ccugggcccagauggcugaa

SEQ ID NO: 9797 - RNA, 20 nt, Homo sapiens
gggccccaccugggcccaga

SEQ ID NO: 9798 - RNA, 20 nt, Homo sapiens
ccaggcucagggccccaccu

SEQ ID NO: 9799 - RNA, 20 nt, Homo sapiens
gccaggcucagggccccacc

SEQ ID NO: 9800 - RNA, 20 nt, Homo sapiens
cagggccugggccaggcuca

SEQ ID NO: 9801 - RNA, 20 nt, Homo sapiens
ccagggccugggccaggcuc

SEQ ID NO: 9802 - RNA, 20 nt, Homo sapiens
auccauccagggccugggcc

SEQ ID NO: 9803 - RNA, 20 nt, Homo sapiens
gggggauccauccagggccu

SEQ ID NO: 9804 - RNA, 20 nt, Homo sapiens
ggggggauccauccagggcc

SEQ ID NO: 9805 - RNA, 20 nt, Homo sapiens
caaauggggggauccaucca

SEQ ID NO: 9806 - RNA, 20 nt, Homo sapiens
ccaaauggggggauccaucc

SEQ ID NO: 9807 - RNA, 20 nt, Homo sapiens
ccugaucucuuccaaauggg

SEQ ID NO: 9808 - RNA, 20 nt, Homo sapiens
accugaucucuuccaaaugg

SEQ ID NO: 9809 - RNA, 20 nt, Homo sapiens
uaccugaucucuuccaaaug

SEQ ID NO: 9810 - RNA, 20 nt, Homo sapiens
uuaccugaucucuuccaaau

SEQ ID NO: 9811 - RNA, 20 nt, Homo sapiens
cuuaccugaucucuuccaaa

SEQ ID NO: 9812 - RNA, 20 nt, Homo sapiens
aucuccccuacccugcagcu

SEQ ID NO: 9813 - RNA, 20 nt, Homo sapiens
uccccuacccugcagcuugg

SEQ ID NO: 9814 - RNA, 20 nt, Homo sapiens
cagcuuggcggaaaacaacc

SEQ ID NO: 9815 - RNA, 20 nt, Homo sapiens
uuggcggaaaacaaccuggc

SEQ ID NO: 9816 - RNA, 20 nt, Homo sapiens
gcggaaaacaaccuggcugg

SEQ ID NO: 9817 - RNA, 20 nt, Homo sapiens
cggaaaacaaccuggcugga

SEQ ID NO: 9818 - RNA, 20 nt, Homo sapiens
ggaaaacaaccuggcuggag

SEQ ID NO: 9819 - RNA, 20 nt, Homo sapiens
agggguccugcguuucugua

SEQ ID NO: 9820 - RNA, 20 nt, Homo sapiens
uccgccaagcugcaggguag

SEQ ID NO: 9821 - RNA, 20 nt, Homo sapiens
uuccgccaagcugcagggua

SEQ ID NO: 9822 - RNA, 20 nt, Homo sapiens
uuuccgccaagcugcagggu

SEQ ID NO: 9823 - RNA, 20 nt, Homo sapiens
uuguuuuccgccaagcugca

SEQ ID NO: 9824 - RNA, 20 nt, Homo sapiens
guuguuuuccgccaagcugc

SEQ ID NO: 9825 - RNA, 20 nt, Homo sapiens
aacgcaggaccccuccagcc

SEQ ID NO: 9826 - RNA, 20 nt, Homo sapiens
ggagcuccauacagaaacgc

SEQ ID NO: 9827 - RNA, 20 nt, Homo sapiens
acucuaucugucugagcagc

SEQ ID NO: 9828 - RNA, 20 nt, Homo sapiens
uacucuaucugucugagcag

SEQ ID NO: 9829 - RNA, 20 nt, Homo sapiens
gcccuucuccauccccagcc

SEQ ID NO: 9830 - RNA, 20 nt, Homo sapiens
ugucaaucuuacaggaaacc

SEQ ID NO: 9831 - RNA, 20 nt, Homo sapiens
agucugguugucaaucuuac

SEQ ID NO: 9832 - RNA, 20 nt, Homo sapiens
aggugaggagcuuggcaguc

SEQ ID NO: 9833 - RNA, 20 nt, Homo sapiens
gaagcuggaggugaggagcu

SEQ ID NO: 9834 - RNA, 20 nt, Homo sapiens
agcucgugaagcuggaggug

SEQ ID NO: 9835 - RNA, 20 nt, Homo sapiens
agggcagcucgugaagcugg

SEQ ID NO: 9836 - RNA, 20 nt, Homo sapiens
ggcagggcagcucgugaagc

SEQ ID NO: 9837 - RNA, 20 nt, Homo sapiens
uguucuaaugaagcagggca

SEQ ID NO: 9838 - RNA, 20 nt, Homo sapiens
guguucuaaugaagcagggc

SEQ ID NO: 9839 - RNA, 20 nt, Homo sapiens
gugaguguucuaaugaagca

SEQ ID NO: 9840 - RNA, 20 nt, Homo sapiens
agugaguguucuaaugaagc

SEQ ID NO: 9841 - RNA, 20 nt, Homo sapiens
cccuacccugcaggcugucc

SEQ ID NO: 9842 - RNA, 20 nt, Homo sapiens
aggcuguccuggaaucuccu

SEQ ID NO: 9843 - RNA, 20 nt, Homo sapiens
ggcuguccuggaaucuccuc

SEQ ID NO: 9844 - RNA, 20 nt, Homo sapiens
gcuguccuggaaucuccucg

SEQ ID NO: 9845 - RNA, 20 nt, Homo sapiens
cuggaaucuccucggggaug

SEQ ID NO: 9846 - RNA, 20 nt, Homo sapiens
ggaugaggcagcugccgagc

SEQ ID NO: 9847 - RNA, 20 nt, Homo sapiens
ggcagcugccgagcuggccc

SEQ ID NO: 9848 - RNA, 20 nt, Homo sapiens
ggcccaggugcugccgcaga

SEQ ID NO: 9849 - RNA, 20 nt, Homo sapiens
gcccaggugcugccgcagau

SEQ ID NO: 9850 - RNA, 20 nt, Homo sapiens
aggugcugccgcagaugggc

SEQ ID NO: 9851 - RNA, 20 nt, Homo sapiens
gaugggccggcugaagagag

SEQ ID NO: 9852 - RNA, 20 nt, Homo sapiens
gcugaagagaguggaguaug

SEQ ID NO: 9853 - RNA, 20 nt, Homo sapiens
cugaagagaguggaguauga

SEQ ID NO: 9854 - RNA, 20 nt, Homo sapiens
ugaagagaguggaguaugag

SEQ ID NO: 9855 - RNA, 20 nt, Homo sapiens
gagaguggaguaugaggggc

SEQ ID NO: 9856 - RNA, 20 nt, Homo sapiens
agaguggaguaugaggggcc

SEQ ID NO: 9857 - RNA, 20 nt, Homo sapiens
gaguggaguaugaggggccg

SEQ ID NO: 9858 - RNA, 20 nt, Homo sapiens
aguggaguaugaggggccgg

SEQ ID NO: 9859 - RNA, 20 nt, Homo sapiens
ggaguaugaggggccggggg

SEQ ID NO: 9860 - RNA, 20 nt, Homo sapiens
caggacagccugcaggguag

SEQ ID NO: 9861 - RNA, 20 nt, Homo sapiens
ccaggacagccugcagggua

SEQ ID NO: 9862 - RNA, 20 nt, Homo sapiens
uccaggacagccugcagggu

SEQ ID NO: 9863 - RNA, 20 nt, Homo sapiens
agauuccaggacagccugca

SEQ ID NO: 9864 - RNA, 20 nt, Homo sapiens
gagauuccaggacagccugc

SEQ ID NO: 9865 - RNA, 20 nt, Homo sapiens
cucauccccgaggagauucc

SEQ ID NO: 9866 - RNA, 20 nt, Homo sapiens
cggcagcugccucauccccg

SEQ ID NO: 9867 - RNA, 20 nt, Homo sapiens
cggcagcaccugggccagcu

SEQ ID NO: 9868 - RNA, 20 nt, Homo sapiens
gcccaucugcggcagcaccu

SEQ ID NO: 9869 - RNA, 20 nt, Homo sapiens
ggcccaucugcggcagcacc

SEQ ID NO: 9870 - RNA, 20 nt, Homo sapiens
cucuucagccggcccaucug

SEQ ID NO: 9871 - RNA, 20 nt, Homo sapiens
cauacuccacucucuucagc

SEQ ID NO: 9872 - RNA, 20 nt, Homo sapiens
ucacuguccacugagaagcc

SEQ ID NO: 9873 - RNA, 20 nt, Homo sapiens
gaagaaucagaucacagcuu

SEQ ID NO: 9874 - RNA, 20 nt, Homo sapiens
aagaaucagaucacagcuuu

SEQ ID NO: 9875 - RNA, 20 nt, Homo sapiens
agaaucagaucacagcuuug

SEQ ID NO: 9876 - RNA, 20 nt, Homo sapiens
gaaucagaucacagcuuugg

SEQ ID NO: 9877 - RNA, 20 nt, Homo sapiens
agaucacagcuuugggggcc

SEQ ID NO: 9878 - RNA, 20 nt, Homo sapiens
agcuuugggggccuggcucc

SEQ ID NO: 9879 - RNA, 20 nt, Homo sapiens
ggggccuggcuccuggcuga

SEQ ID NO: 9880 - RNA, 20 nt, Homo sapiens
cuggcuccuggcugaaggac

SEQ ID NO: 9881 - RNA, 20 nt, Homo sapiens
ccuggcugaaggacuggccc

SEQ ID NO: 9882 - RNA, 20 nt, Homo sapiens
cuggcugaaggacuggccca

SEQ ID NO: 9883 - RNA, 20 nt, Homo sapiens
uggcugaaggacuggcccag

SEQ ID NO: 9884 - RNA, 20 nt, Homo sapiens
ggucuagcauccaagucauc

SEQ ID NO: 9885 - RNA, 20 nt, Homo sapiens
uccaagucauccgguaacag

SEQ ID NO: 9886 - RNA, 20 nt, Homo sapiens
auccgguaacagaggccugc

SEQ ID NO: 9887 - RNA, 20 nt, Homo sapiens
uccgguaacagaggccugca

SEQ ID NO: 9888 - RNA, 20 nt, Homo sapiens
ccgguaacagaggccugcag

SEQ ID NO: 9889 - RNA, 20 nt, Homo sapiens
aggcuucucaguggacagug

SEQ ID NO: 9890 - RNA, 20 nt, Homo sapiens
uucuucuccaggcuucucag

SEQ ID NO: 9891 - RNA, 20 nt, Homo sapiens
cugugaucugauucuucucc

SEQ ID NO: 9892 - RNA, 20 nt, Homo sapiens
caguccuucagccaggagcc

SEQ ID NO: 9893 - RNA, 20 nt, Homo sapiens
ccugggccaguccuucagcc

SEQ ID NO: 9894 - RNA, 20 nt, Homo sapiens
gacuuggaugcuagaccccu

SEQ ID NO: 9895 - RNA, 20 nt, Homo sapiens
ugacuuggaugcuagacccc

SEQ ID NO: 9896 - RNA, 20 nt, Homo sapiens
gccucuguuaccggaugacu

SEQ ID NO: 9897 - RNA, 20 nt, Homo sapiens
ccccugcaggccucuguuac

SEQ ID NO: 9898 - RNA, 20 nt, Homo sapiens
uaucugugccccacagccuc

SEQ ID NO: 9899 - RNA, 20 nt, Homo sapiens
uaaccccauucccugcgaca

SEQ ID NO: 9900 - RNA, 20 nt, Homo sapiens
ggcccagcaccugaagagcc

SEQ ID NO: 9901 - RNA, 20 nt, Homo sapiens
accugaagagccaggagccc

SEQ ID NO: 9902 - RNA, 20 nt, Homo sapiens
gaagagccaggagcccaggc

SEQ ID NO: 9903 - RNA, 20 nt, Homo sapiens
cuucuuugacaaccagcccc

SEQ ID NO: 9904 - RNA, 20 nt, Homo sapiens
acaaccagccccaggccccu

SEQ ID NO: 9905 - RNA, 20 nt, Homo sapiens
caaccagccccaggccccuu

SEQ ID NO: 9906 - RNA, 20 nt, Homo sapiens
aaccagccccaggccccuug

SEQ ID NO: 9907 - RNA, 20 nt, Homo sapiens
aggccccuugggguacuuga

SEQ ID NO: 9908 - RNA, 20 nt, Homo sapiens
gauggcccccucaagaccuu

SEQ ID NO: 9909 - RNA, 20 nt, Homo sapiens
augauccaccuuucgcccac

SEQ ID NO: 9910 - RNA, 20 nt, Homo sapiens
ugauccaccuuucgcccacu

SEQ ID NO: 9911 - RNA, 20 nt, Homo sapiens
cccacugggauaauugacuc

SEQ ID NO: 9912 - RNA, 20 nt, Homo sapiens
gacucaggaaagaagagccu

SEQ ID NO: 9913 - RNA, 20 nt, Homo sapiens
caggaaagaagagccucggc

SEQ ID NO: 9914 - RNA, 20 nt, Homo sapiens
aggaaagaagagccucggca

SEQ ID NO: 9915 - RNA, 20 nt, Homo sapiens
gggcgcucugcacuccaccc

SEQ ID NO: 9916 - RNA, 20 nt, Homo sapiens
cgcucugcacuccacccagg

SEQ ID NO: 9917 - RNA, 20 nt, Homo sapiens
cugcacuccacccaggagga

SEQ ID NO: 9918 - RNA, 20 nt, Homo sapiens
uguguccugcugcaguccuc

SEQ ID NO: 9919 - RNA, 20 nt, Homo sapiens
guguccugcugcaguccuca

SEQ ID NO: 9920 - RNA, 20 nt, Homo sapiens
guccucagggagaacuuuuu

SEQ ID NO: 9921 - RNA, 20 nt, Homo sapiens
uccucagggagaacuuuuuu

SEQ ID NO: 9922 - RNA, 20 nt, Homo sapiens
ggagaacuuuuuugggaacc

SEQ ID NO: 9923 - RNA, 20 nt, Homo sapiens
cuuuuuugggaaccaggagc

SEQ ID NO: 9924 - RNA, 20 nt, Homo sapiens
uuuuuugggaaccaggagcu

SEQ ID NO: 9925 - RNA, 20 nt, Homo sapiens
ugggaaccaggagcuggguc

SEQ ID NO: 9926 - RNA, 20 nt, Homo sapiens
caggagcugggucuggacaa

SEQ ID NO: 9927 - RNA, 20 nt, Homo sapiens
aaggaguacccugcauuacg

SEQ ID NO: 9928 - RNA, 20 nt, Homo sapiens
aggaguacccugcauuacgu

SEQ ID NO: 9929 - RNA, 20 nt, Homo sapiens
gugggauaugugugaucaau

SEQ ID NO: 9930 - RNA, 20 nt, Homo sapiens
ugggauaugugugaucaauu

SEQ ID NO: 9931 - RNA, 20 nt, Homo sapiens
gggauaugugugaucaauug

SEQ ID NO: 9932 - RNA, 20 nt, Homo sapiens
gggacaugcgacacacaaug

SEQ ID NO: 9933 - RNA, 20 nt, Homo sapiens
ggacaugcgacacacaauga

SEQ ID NO: 9934 - RNA, 20 nt, Homo sapiens
augacaaugcaugacacgua

SEQ ID NO: 9935 - RNA, 20 nt, Homo sapiens
augacacguacgguuauaug

SEQ ID NO: 9936 - RNA, 20 nt, Homo sapiens
cagugugaccccuugacaug

SEQ ID NO: 9937 - RNA, 20 nt, Homo sapiens
gcguuacaugaaagucagug

SEQ ID NO: 9938 - RNA, 20 nt, Homo sapiens
ucaguguggcacguguucug

SEQ ID NO: 9939 - RNA, 20 nt, Homo sapiens
guggcacguguucuguggca

SEQ ID NO: 9940 - RNA, 20 nt, Homo sapiens
uggcacguguucuguggcau

SEQ ID NO: 9941 - RNA, 20 nt, Homo sapiens
guguucuguggcaugggugc

SEQ ID NO: 9942 - RNA, 20 nt, Homo sapiens
gugcuggcaucccaaguagc

SEQ ID NO: 9943 - RNA, 20 nt, Homo sapiens
guagcaggauacaugauugu

SEQ ID NO: 9944 - RNA, 20 nt, Homo sapiens
augacaaauguccaugucac

SEQ ID NO: 9945 - RNA, 20 nt, Homo sapiens
uguccaugucacaggacuca

SEQ ID NO: 9946 - RNA, 20 nt, Homo sapiens
caugucacaggacucauggc

SEQ ID NO: 9947 - RNA, 20 nt, Homo sapiens
auggcuggccagaugaccuc

SEQ ID NO: 9948 - RNA, 20 nt, Homo sapiens
cuggccagaugaccucaggc

SEQ ID NO: 9949 - RNA, 20 nt, Homo sapiens
auauuuauagauugugugua

SEQ ID NO: 9950 - RNA, 20 nt, Homo sapiens
guguauggagcagcuaaguc

SEQ ID NO: 9951 - RNA, 20 nt, Homo sapiens
gaaaagucuuccgcccgagc

SEQ ID NO: 9952 - RNA, 20 nt, Homo sapiens
aaaagucuuccgcccgagcu

SEQ ID NO: 9953 - RNA, 20 nt, Homo sapiens
agucuuccgcccgagcuggg

SEQ ID NO: 9954 - RNA, 20 nt, Homo sapiens
gucuuccgcccgagcuggga

SEQ ID NO: 9955 - RNA, 20 nt, Homo sapiens
ucuuccgcccgagcugggag

SEQ ID NO: 9956 - RNA, 20 nt, Homo sapiens
guccaugcacugaccagucc

SEQ ID NO: 9957 - RNA, 20 nt, Homo sapiens
uccaugcacugaccagucca

SEQ ID NO: 9958 - RNA, 20 nt, Homo sapiens
ccaugcacugaccaguccag

SEQ ID NO: 9959 - RNA, 20 nt, Homo sapiens
cugaccaguccaggggcuca

SEQ ID NO: 9960 - RNA, 20 nt, Homo sapiens
ugaccaguccaggggcucaa

SEQ ID NO: 9961 - RNA, 20 nt, Homo sapiens
aguccaggggcucaagggcc

SEQ ID NO: 9962 - RNA, 20 nt, Homo sapiens
guccaggggcucaagggcca

SEQ ID NO: 9963 - RNA, 20 nt, Homo sapiens
gggcucaagggccagggcuc

SEQ ID NO: 9964 - RNA, 20 nt, Homo sapiens
ccagggcucuggaacaagcc

SEQ ID NO: 9965 - RNA, 20 nt, Homo sapiens
cagggcucuggaacaagcca

SEQ ID NO: 9966 - RNA, 20 nt, Homo sapiens
uacuuacauacuagcuucca

SEQ ID NO: 9967 - RNA, 20 nt, Homo sapiens
acauacuagcuuccaaggac

SEQ ID NO: 9968 - RNA, 20 nt, Homo sapiens
uacuagcuuccaaggacagg

SEQ ID NO: 9969 - RNA, 20 nt, Homo sapiens
uagcuuccaaggacaggugg

SEQ ID NO: 9970 - RNA, 20 nt, Homo sapiens
uuccaaggacagguggaggu

SEQ ID NO: 9971 - RNA, 20 nt, Homo sapiens
uccaaggacagguggaggua

SEQ ID NO: 9972 - RNA, 20 nt, Homo sapiens
agguggagguagggccagcc

SEQ ID NO: 9973 - RNA, 20 nt, Homo sapiens
uggagguagggccagccugg

SEQ ID NO: 9974 - RNA, 20 nt, Homo sapiens
ggagguagggccagccuggc

SEQ ID NO: 9975 - RNA, 20 nt, Homo sapiens
uagggccagccuggcgggag

SEQ ID NO: 9976 - RNA, 20 nt, Homo sapiens
agcccagucuguccuaugua

SEQ ID NO: 9977 - RNA, 20 nt, Homo sapiens
gcccagucuguccuauguaa

SEQ ID NO: 9978 - RNA, 20 nt, Homo sapiens
ccuauguaagggacaaagcc

SEQ ID NO: 9979 - RNA, 20 nt, Homo sapiens
agggacaaagccaggucuaa

SEQ ID NO: 9980 - RNA, 20 nt, Homo sapiens
aaagccaggucuaaugguac

SEQ ID NO: 9981 - RNA, 20 nt, Homo sapiens
aagccaggucuaaugguacu

SEQ ID NO: 9982 - RNA, 20 nt, Homo sapiens
caggucuaaugguacugggu

SEQ ID NO: 9983 - RNA, 20 nt, Homo sapiens
aggucuaaugguacugggua

SEQ ID NO: 9984 - RNA, 20 nt, Homo sapiens
ggucuaaugguacuggguag

SEQ ID NO: 9985 - RNA, 20 nt, Homo sapiens
gucuaaugguacuggguagg

SEQ ID NO: 9986 - RNA, 20 nt, Homo sapiens
cacugccaagacaauaagcu

SEQ ID NO: 9987 - RNA, 20 nt, Homo sapiens
aagacaauaagcuaggcuac

SEQ ID NO: 9988 - RNA, 20 nt, Homo sapiens
agacaauaagcuaggcuacu

SEQ ID NO: 9989 - RNA, 20 nt, Homo sapiens
acuggguccagcuacuacuu

SEQ ID NO: 9990 - RNA, 20 nt, Homo sapiens
ggguccagcuacuacuuugg

SEQ ID NO: 9991 - RNA, 20 nt, Homo sapiens
gguccagcuacuacuuuggu

SEQ ID NO: 9992 - RNA, 20 nt, Homo sapiens
cuacuacuuuggugggauuc

SEQ ID NO: 9993 - RNA, 20 nt, Homo sapiens
caguguucuuguuacuucca

SEQ ID NO: 9994 - RNA, 20 nt, Homo sapiens
cuuccaaggagaaccaagaa

SEQ ID NO: 9995 - RNA, 20 nt, Homo sapiens
gcucugucacacucgaagcc

SEQ ID NO: 9996 - RNA, 20 nt, Homo sapiens
ggcuugaucaauaaacacaa

SEQ ID NO: 9997 - RNA, 20 nt, Homo sapiens
aggcuguggggcacagauau

SEQ ID NO: 9998 - RNA, 20 nt, Homo sapiens
ggguuauuccagaggcugug

SEQ ID NO: 9999 - RNA, 20 nt, Homo sapiens
gggguuauuccagaggcugu

SEQ ID NO: 10000 - RNA, 20 nt, Homo sapiens
ugggguuauuccagaggcug

SEQ ID NO: 10001 - RNA, 20 nt, Homo sapiens
agggaaugggguuauuccag

SEQ ID NO: 10002 - RNA, 20 nt, Homo sapiens
gggccaugucgcagggaaug

SEQ ID NO: 10003 - RNA, 20 nt, Homo sapiens
ugggccaugucgcagggaau

SEQ ID NO: 10004 - RNA, 20 nt, Homo sapiens
cugggccaugucgcagggaa

SEQ ID NO: 10005 - RNA, 20 nt, Homo sapiens
aggugcugggccaugucgca

SEQ ID NO: 10006 - RNA, 20 nt, Homo sapiens
caggugcugggccaugucgc

SEQ ID NO: 10007 - RNA, 20 nt, Homo sapiens
cuccuggcucuucaggugcu

SEQ ID NO: 10008 - RNA, 20 nt, Homo sapiens
gcuccuggcucuucaggugc

SEQ ID NO: 10009 - RNA, 20 nt, Homo sapiens
gccugggcuccuggcucuuc

SEQ ID NO: 10010 - RNA, 20 nt, Homo sapiens
caaaguccagccugggcucc

SEQ ID NO: 10011 - RNA, 20 nt, Homo sapiens
aagaaggcaaaguccagccu

SEQ ID NO: 10012 - RNA, 20 nt, Homo sapiens
aaagaaggcaaaguccagcc

SEQ ID NO: 10013 - RNA, 20 nt, Homo sapiens
cuggggcugguugucaaaga

SEQ ID NO: 10014 - RNA, 20 nt, Homo sapiens
uaccccaaggggccuggggc

SEQ ID NO: 10015 - RNA, 20 nt, Homo sapiens
caaguaccccaaggggccug

SEQ ID NO: 10016 - RNA, 20 nt, Homo sapiens
ucaaguaccccaaggggccu

SEQ ID NO: 10017 - RNA, 20 nt, Homo sapiens
aucaaguaccccaaggggcc

SEQ ID NO: 10018 - RNA, 20 nt, Homo sapiens
gggccaucaaguaccccaag

SEQ ID NO: 10019 - RNA, 20 nt, Homo sapiens
ggggccaucaaguaccccaa

SEQ ID NO: 10020 - RNA, 20 nt, Homo sapiens
gggggccaucaaguacccca

SEQ ID NO: 10021 - RNA, 20 nt, Homo sapiens
ggauuccaaaggucuugagg

SEQ ID NO: 10022 - RNA, 20 nt, Homo sapiens
uggauuccaaaggucuugag

SEQ ID NO: 10023 - RNA, 20 nt, Homo sapiens
cuggauuccaaaggucuuga

SEQ ID NO: 10024 - RNA, 20 nt, Homo sapiens
gcuggauuccaaaggucuug

SEQ ID NO: 10025 - RNA, 20 nt, Homo sapiens
aucacuuggcuggauuccaa

SEQ ID NO: 10026 - RNA, 20 nt, Homo sapiens
auuugggugcaucacuuggc

SEQ ID NO: 10027 - RNA, 20 nt, Homo sapiens
gaucauuugggugcaucacu

SEQ ID NO: 10028 - RNA, 20 nt, Homo sapiens
gggcgaaagguggaucauuu

SEQ ID NO: 10029 - RNA, 20 nt, Homo sapiens
ugggcgaaagguggaucauu

SEQ ID NO: 10030 - RNA, 20 nt, Homo sapiens
uuaucccagugggcgaaagg

SEQ ID NO: 10031 - RNA, 20 nt, Homo sapiens
caauuaucccagugggcgaa

SEQ ID NO: 10032 - RNA, 20 nt, Homo sapiens
ccugagucaauuaucccagu

SEQ ID NO: 10033 - RNA, 20 nt, Homo sapiens
uccugagucaauuaucccag

SEQ ID NO: 10034 - RNA, 20 nt, Homo sapiens
gagugcagagcgcccugccg

SEQ ID NO: 10035 - RNA, 20 nt, Homo sapiens
cacguauccuuccuccuggg

SEQ ID NO: 10036 - RNA, 20 nt, Homo sapiens
acacacguauccuuccuccu

SEQ ID NO: 10037 - RNA, 20 nt, Homo sapiens
gacacacguauccuuccucc

SEQ ID NO: 10038 - RNA, 20 nt, Homo sapiens
uucucccugaggacugcagc

SEQ ID NO: 10039 - RNA, 20 nt, Homo sapiens
ucccaaaaaaguucucccug

SEQ ID NO: 10040 - RNA, 20 nt, Homo sapiens
cuuuguccagacccagcucc

SEQ ID NO: 10041 - RNA, 20 nt, Homo sapiens
cacauaucccacguaaugca

SEQ ID NO: 10042 - RNA, 20 nt, Homo sapiens
acacauaucccacguaaugc

SEQ ID NO: 10043 - RNA, 20 nt, Homo sapiens
auguaacgccacaugucaag

SEQ ID NO: 10044 - RNA, 20 nt, Homo sapiens
cauguaacgccacaugucaa

SEQ ID NO: 10045 - RNA, 20 nt, Homo sapiens
ucauguaacgccacauguca

SEQ ID NO: 10046 - RNA, 20 nt, Homo sapiens
aaucauguauccugcuacuu

SEQ ID NO: 10047 - RNA, 20 nt, Homo sapiens
caaucauguauccugcuacu

SEQ ID NO: 10048 - RNA, 20 nt, Homo sapiens
cagccaugaguccugugaca

SEQ ID NO: 10049 - RNA, 20 nt, Homo sapiens
ugggccagccugaggucauc

SEQ ID NO: 10050 - RNA, 20 nt, Homo sapiens
uuagaucuugggccagccug

SEQ ID NO: 10051 - RNA, 20 nt, Homo sapiens
aaauuaauaaauuagaucuu

SEQ ID NO: 10052 - RNA, 20 nt, Homo sapiens
aaaauuaauaaauuagaucu

SEQ ID NO: 10053 - RNA, 20 nt, Homo sapiens
cucuccccucccagcucggg

SEQ ID NO: 10054 - RNA, 20 nt, Homo sapiens
acacucuccccucccagcuc

SEQ ID NO: 10055 - RNA, 20 nt, Homo sapiens
gacacucuccccucccagcu

SEQ ID NO: 10056 - RNA, 20 nt, Homo sapiens
ccccuggacuggucagugca

SEQ ID NO: 10057 - RNA, 20 nt, Homo sapiens
uggcccuugagccccuggac

SEQ ID NO: 10058 - RNA, 20 nt, Homo sapiens
agcccuggcccuugagcccc

SEQ ID NO: 10059 - RNA, 20 nt, Homo sapiens
ccuggcuuguuccagagccc

SEQ ID NO: 10060 - RNA, 20 nt, Homo sapiens
ggacuuaauggcugaguccc

SEQ ID NO: 10061 - RNA, 20 nt, Homo sapiens
ugaggcaggaggggacuuaa

SEQ ID NO: 10062 - RNA, 20 nt, Homo sapiens
gcugaggauugaggcaggag

SEQ ID NO: 10063 - RNA, 20 nt, Homo sapiens
ggcugaggauugaggcagga

SEQ ID NO: 10064 - RNA, 20 nt, Homo sapiens
aggcugaggauugaggcagg

SEQ ID NO: 10065 - RNA, 20 nt, Homo sapiens
gguaggcugaggauugaggc

SEQ ID NO: 10066 - RNA, 20 nt, Homo sapiens
gauggguaggcugaggauug

SEQ ID NO: 10067 - RNA, 20 nt, Homo sapiens
guuuauagauggguaggcug

SEQ ID NO: 10068 - RNA, 20 nt, Homo sapiens
caucaaguuuauagaugggu

SEQ ID NO: 10069 - RNA, 20 nt, Homo sapiens
gagucaucaaguuuauagau

SEQ ID NO: 10070 - RNA, 20 nt, Homo sapiens
ggagucaucaaguuuauaga

SEQ ID NO: 10071 - RNA, 20 nt, Homo sapiens
agcuaguauguaaguaaggg

SEQ ID NO: 10072 - RNA, 20 nt, Homo sapiens
ggaagcuaguauguaaguaa

SEQ ID NO: 10073 - RNA, 20 nt, Homo sapiens
uggaagcuaguauguaagua

SEQ ID NO: 10074 - RNA, 20 nt, Homo sapiens
gcccuaccuccaccuguccu

SEQ ID NO: 10075 - RNA, 20 nt, Homo sapiens
cuucuccacucccgccaggc

SEQ ID NO: 10076 - RNA, 20 nt, Homo sapiens
ugggcuucuccacucccgcc

SEQ ID NO: 10077 - RNA, 20 nt, Homo sapiens
ucccuuacauaggacagacu

SEQ ID NO: 10078 - RNA, 20 nt, Homo sapiens
gucccuuacauaggacagac

SEQ ID NO: 10079 - RNA, 20 nt, Homo sapiens
ccuggcuuugucccuuacau

SEQ ID NO: 10080 - RNA, 20 nt, Homo sapiens
cuacccaguaccauuagacc

SEQ ID NO: 10081 - RNA, 20 nt, Homo sapiens
aguagccuagcuuauugucu

SEQ ID NO: 10082 - RNA, 20 nt, Homo sapiens
aaucccaccaaaguaguagc

SEQ ID NO: 10083 - RNA, 20 nt, Homo sapiens
uggguaacaugugaagugca

SEQ ID NO: 10084 - RNA, 20 nt, Homo sapiens
uuggaaguaacaagaacacu

SEQ ID NO: 10085 - RNA, 20 nt, Homo sapiens
cuuggaaguaacaagaacac

SEQ ID NO: 10086 - RNA, 20 nt, Homo sapiens
gagccauucuugguucuccu

SEQ ID NO: 10087 - RNA, 20 nt, Homo sapiens
gagugugacagagccauucu

SEQ ID NO: 10088 - RNA, 20 nt, Homo sapiens
uuguguuuauugaucaagcc

SEQ ID NO: 10089 - RNA, 20 nt, Homo sapiens
cauuggauucacgcuagacg

SEQ ID NO: 10090 - RNA, 20 nt, Homo sapiens
uaaaaaggggaaguuaagag

SEQ ID NO: 10091 - RNA, 20 nt, Homo sapiens
gaaguuaagaggggacuauu

SEQ ID NO: 10092 - RNA, 20 nt, Homo sapiens
cugccacacgcagcucagcc

SEQ ID NO: 10093 - RNA, 20 nt, Homo sapiens
ugccacacgcagcucagccu

SEQ ID NO: 10094 - RNA, 20 nt, Homo sapiens
cacacgcagcucagccuggg

SEQ ID NO: 10095 - RNA, 20 nt, Homo sapiens
aucugagucugccugcagca

SEQ ID NO: 10096 - RNA, 20 nt, Homo sapiens
gucugccugcagcauggacc

SEQ ID NO: 10097 - RNA, 20 nt, Homo sapiens
ucugccugcagcauggaccu

SEQ ID NO: 10098 - RNA, 20 nt, Homo sapiens
gucuucccugaagcaucucc

SEQ ID NO: 10099 - RNA, 20 nt, Homo sapiens
ucuucccugaagcaucucca

SEQ ID NO: 10100 - RNA, 20 nt, Homo sapiens
cccugaagcaucuccagggc

SEQ ID NO: 10101 - RNA, 20 nt, Homo sapiens
ugaagcaucuccagggcugg

SEQ ID NO: 10102 - RNA, 20 nt, Homo sapiens
gaagcaucuccagggcugga

SEQ ID NO: 10103 - RNA, 20 nt, Homo sapiens
ggcuggagggacgacugcca

SEQ ID NO: 10104 - RNA, 20 nt, Homo sapiens
gagggacgacugccauggua

SEQ ID NO: 10105 - RNA, 20 nt, Homo sapiens
cuuucuugacacuggauugu

SEQ ID NO: 10106 - RNA, 20 nt, Homo sapiens
ucuuucuugacacuggauug

SEQ ID NO: 10107 - RNA, 20 nt, Homo sapiens
guugacuucuuucuugacac

SEQ ID NO: 10108 - RNA, 20 nt, Homo sapiens
aagagaaaugcagggaaaua

SEQ ID NO: 10109 - RNA, 20 nt, Homo sapiens
gaagagaaaugcagggaaau

SEQ ID NO: 10110 - RNA, 20 nt, Homo sapiens
gagcacagaagagaaaugca

SEQ ID NO: 10111 - RNA, 20 nt, Homo sapiens
ugagcacagaagagaaaugc

SEQ ID NO: 10112 - RNA, 20 nt, Homo sapiens
cgcccaggcugagcugcgug

SEQ ID NO: 10113 - RNA, 20 nt, Homo sapiens
cgcaucuggcugugccgccc

SEQ ID NO: 10114 - RNA, 20 nt, Homo sapiens
gcagagacgcaucucgcauc

SEQ ID NO: 10115 - RNA, 20 nt, Homo sapiens
aagacccagguccaugcugc

SEQ ID NO: 10116 - RNA, 20 nt, Homo sapiens
agaugcuucagggaagaccc

SEQ ID NO: 10117 - RNA, 20 nt, Homo sapiens
ccagcccuggagaugcuuca

SEQ ID NO: 10118 - RNA, 20 nt, Homo sapiens
uccagcccuggagaugcuuc

SEQ ID NO: 10119 - RNA, 20 nt, Homo sapiens
ggcagucgucccuccagccc

SEQ ID NO: 10120 - RNA, 20 nt, Homo sapiens
guguugugggguccuuacca

SEQ ID NO: 10121 - RNA, 20 nt, Homo sapiens
ucucuauccugccagcaccg

SEQ ID NO: 10122 - RNA, 20 nt, Homo sapiens
cucuauccugccagcaccga

SEQ ID NO: 10123 - RNA, 20 nt, Homo sapiens
ggcucauccauccacagagc

SEQ ID NO: 10124 - RNA, 20 nt, Homo sapiens
gcucauccauccacagagca

SEQ ID NO: 10125 - RNA, 20 nt, Homo sapiens
ccauccacagagcagggcag

SEQ ID NO: 10126 - RNA, 20 nt, Homo sapiens
cauccacagagcagggcagu

SEQ ID NO: 10127 - RNA, 20 nt, Homo sapiens
ccacagagcagggcaguggg

SEQ ID NO: 10128 - RNA, 20 nt, Homo sapiens
cgccaugacccccauccuca

SEQ ID NO: 10129 - RNA, 20 nt, Homo sapiens
cucacgguccugaucugucu

SEQ ID NO: 10130 - RNA, 20 nt, Homo sapiens
gucucggugagauuugaaga

SEQ ID NO: 10131 - RNA, 20 nt, Homo sapiens
ucggugagauuugaagaagg

SEQ ID NO: 10132 - RNA, 20 nt, Homo sapiens
gaugagcccucggugcuggc

SEQ ID NO: 10133 - RNA, 20 nt, Homo sapiens
gauggaugagcccucggugc

SEQ ID NO: 10134 - RNA, 20 nt, Homo sapiens
ucuguggauggaugagcccu

SEQ ID NO: 10135 - RNA, 20 nt, Homo sapiens
ccacugcccugcucugugga

SEQ ID NO: 10136 - RNA, 20 nt, Homo sapiens
ccucccacugcccugcucug

SEQ ID NO: 10137 - RNA, 20 nt, Homo sapiens
gaccgugaggauggggguca

SEQ ID NO: 10138 - RNA, 20 nt, Homo sapiens
gaucaggaccgugaggaugg

SEQ ID NO: 10139 - RNA, 20 nt, Homo sapiens
agaucaggaccgugaggaug

SEQ ID NO: 10140 - RNA, 20 nt, Homo sapiens
cagaucaggaccgugaggau

SEQ ID NO: 10141 - RNA, 20 nt, Homo sapiens
acagaucaggaccgugagga

SEQ ID NO: 10142 - RNA, 20 nt, Homo sapiens
cgagacagaucaggaccgug

SEQ ID NO: 10143 - RNA, 20 nt, Homo sapiens
aaaucucaccgagacagauc

SEQ ID NO: 10144 - RNA, 20 nt, Homo sapiens
cucucuuccagggcugaguc

SEQ ID NO: 10145 - RNA, 20 nt, Homo sapiens
ucucuuccagggcugagucu

SEQ ID NO: 10146 - RNA, 20 nt, Homo sapiens
cagggcugagucugggcccc

SEQ ID NO: 10147 - RNA, 20 nt, Homo sapiens
gggcccccggacccacgugc

SEQ ID NO: 10148 - RNA, 20 nt, Homo sapiens
ccccggacccacgugcaggc

SEQ ID NO: 10149 - RNA, 20 nt, Homo sapiens
cagcccuggaagagaguucc

SEQ ID NO: 10150 - RNA, 20 nt, Homo sapiens
cgggggcccagacucagccc

SEQ ID NO: 10151 - RNA, 20 nt, Homo sapiens
cugccugcacguggguccgg

SEQ ID NO: 10152 - RNA, 20 nt, Homo sapiens
ccugccugcacguggguccg

SEQ ID NO: 10153 - RNA, 20 nt, Homo sapiens
accugccugcacgugggucc

SEQ ID NO: 10154 - RNA, 20 nt, Homo sapiens
caccugccugcacguggguc

SEQ ID NO: 10155 - RNA, 20 nt, Homo sapiens
agacucaccugccugcacgu

SEQ ID NO: 10156 - RNA, 20 nt, Homo sapiens
cagacucaccugccugcacg

SEQ ID NO: 10157 - RNA, 20 nt, Homo sapiens
accuccccaagcccacccuc

SEQ ID NO: 10158 - RNA, 20 nt, Homo sapiens
ccuccccaagcccacccucu

SEQ ID NO: 10159 - RNA, 20 nt, Homo sapiens
cccacccucugggcugaacc

SEQ ID NO: 10160 - RNA, 20 nt, Homo sapiens
accaggcucugugaucaccc

SEQ ID NO: 10161 - RNA, 20 nt, Homo sapiens
ccaggcucugugaucaccca

SEQ ID NO: 10162 - RNA, 20 nt, Homo sapiens
caggcucugugaucacccag

SEQ ID NO: 10163 - RNA, 20 nt, Homo sapiens
aggggaguccugugacccuc

SEQ ID NO: 10164 - RNA, 20 nt, Homo sapiens
uccugugacccucagguguc

SEQ ID NO: 10165 - RNA, 20 nt, Homo sapiens
ccugugacccucagguguca

SEQ ID NO: 10166 - RNA, 20 nt, Homo sapiens
cugugacccucaggugucag

SEQ ID NO: 10167 - RNA, 20 nt, Homo sapiens
ugugacccucaggugucagg

SEQ ID NO: 10168 - RNA, 20 nt, Homo sapiens
gugacccucaggugucaggg

SEQ ID NO: 10169 - RNA, 20 nt, Homo sapiens
ccucaggugucaggggggcc

SEQ ID NO: 10170 - RNA, 20 nt, Homo sapiens
ucaggggggccaggagaccc

SEQ ID NO: 10171 - RNA, 20 nt, Homo sapiens
gagaaaagaaaacagcaccc

SEQ ID NO: 10172 - RNA, 20 nt, Homo sapiens
aaacagcacccuggauuaca

SEQ ID NO: 10173 - RNA, 20 nt, Homo sapiens
cuggauuacacggaucccac

SEQ ID NO: 10174 - RNA, 20 nt, Homo sapiens
cccacaggagcuugugaaga

SEQ ID NO: 10175 - RNA, 20 nt, Homo sapiens
ccacaggagcuugugaagaa

SEQ ID NO: 10176 - RNA, 20 nt, Homo sapiens
uccccaucccauccaucacc

SEQ ID NO: 10177 - RNA, 20 nt, Homo sapiens
ccccaucccauccaucaccu

SEQ ID NO: 10178 - RNA, 20 nt, Homo sapiens
uccaucaccugggaacacac

SEQ ID NO: 10179 - RNA, 20 nt, Homo sapiens
ccaucaccugggaacacaca

SEQ ID NO: 10180 - RNA, 20 nt, Homo sapiens
ucaccugggaacacacaggg

SEQ ID NO: 10181 - RNA, 20 nt, Homo sapiens
gggcgguaucgcuguuacua

SEQ ID NO: 10182 - RNA, 20 nt, Homo sapiens
uacuaugguagcgacacugc

SEQ ID NO: 10183 - RNA, 20 nt, Homo sapiens
cucagagagcagugaccccc

SEQ ID NO: 10184 - RNA, 20 nt, Homo sapiens
gagcagugacccccuggagc

SEQ ID NO: 10185 - RNA, 20 nt, Homo sapiens
cagugacccccuggagcugg

SEQ ID NO: 10186 - RNA, 20 nt, Homo sapiens
ccccuggagcugguggugac

SEQ ID NO: 10187 - RNA, 20 nt, Homo sapiens
ugacaggugagcugacacuc

SEQ ID NO: 10188 - RNA, 20 nt, Homo sapiens
gacaggugagcugacacuca

SEQ ID NO: 10189 - RNA, 20 nt, Homo sapiens
acaggugagcugacacucag

SEQ ID NO: 10190 - RNA, 20 nt, Homo sapiens
aggugcccuggaaggaaauc

SEQ ID NO: 10191 - RNA, 20 nt, Homo sapiens
gcuuggggaggugcccugga

SEQ ID NO: 10192 - RNA, 20 nt, Homo sapiens
gugggcuuggggaggugccc

SEQ ID NO: 10193 - RNA, 20 nt, Homo sapiens
cccagagggugggcuugggg

SEQ ID NO: 10194 - RNA, 20 nt, Homo sapiens
cagcccagagggugggcuug

SEQ ID NO: 10195 - RNA, 20 nt, Homo sapiens
ucagcccagagggugggcuu

SEQ ID NO: 10196 - RNA, 20 nt, Homo sapiens
uucagcccagagggugggcu

SEQ ID NO: 10197 - RNA, 20 nt, Homo sapiens
ccugguucagcccagagggu

SEQ ID NO: 10198 - RNA, 20 nt, Homo sapiens
gccugguucagcccagaggg

SEQ ID NO: 10199 - RNA, 20 nt, Homo sapiens
agagccugguucagcccaga

SEQ ID NO: 10200 - RNA, 20 nt, Homo sapiens
cagagccugguucagcccag

SEQ ID NO: 10201 - RNA, 20 nt, Homo sapiens
cccugggugaucacagagcc

SEQ ID NO: 10202 - RNA, 20 nt, Homo sapiens
gagggucacaggacuccccu

SEQ ID NO: 10203 - RNA, 20 nt, Homo sapiens
ugagggucacaggacucccc

SEQ ID NO: 10204 - RNA, 20 nt, Homo sapiens
cccugacaccugagggucac

SEQ ID NO: 10205 - RNA, 20 nt, Homo sapiens
cuggccccccugacaccuga

SEQ ID NO: 10206 - RNA, 20 nt, Homo sapiens
ccuggccccccugacaccug

SEQ ID NO: 10207 - RNA, 20 nt, Homo sapiens
gacgguacuccugggucucc

SEQ ID NO: 10208 - RNA, 20 nt, Homo sapiens
ucuauauagacgguacuccu

SEQ ID NO: 10209 - RNA, 20 nt, Homo sapiens
cucuauauagacgguacucc

SEQ ID NO: 10210 - RNA, 20 nt, Homo sapiens
uuuucuuuucucuauauaga

SEQ ID NO: 10211 - RNA, 20 nt, Homo sapiens
ugugggauccguguaaucca

SEQ ID NO: 10212 - RNA, 20 nt, Homo sapiens
cugugggauccguguaaucc

SEQ ID NO: 10213 - RNA, 20 nt, Homo sapiens
ccuucuucacaagcuccugu

SEQ ID NO: 10214 - RNA, 20 nt, Homo sapiens
cccuucuucacaagcuccug

SEQ ID NO: 10215 - RNA, 20 nt, Homo sapiens
ugauggaugggauggggaac

SEQ ID NO: 10216 - RNA, 20 nt, Homo sapiens
cccaggugauggaugggaug

SEQ ID NO: 10217 - RNA, 20 nt, Homo sapiens
ucccaggugauggaugggau

SEQ ID NO: 10218 - RNA, 20 nt, Homo sapiens
uucccaggugauggauggga

SEQ ID NO: 10219 - RNA, 20 nt, Homo sapiens
uguguucccaggugauggau

SEQ ID NO: 10220 - RNA, 20 nt, Homo sapiens
guguguucccaggugaugga

SEQ ID NO: 10221 - RNA, 20 nt, Homo sapiens
cccuguguguucccagguga

SEQ ID NO: 10222 - RNA, 20 nt, Homo sapiens
auaccgcccuguguguuccc

SEQ ID NO: 10223 - RNA, 20 nt, Homo sapiens
gggggucacugcucucugag

SEQ ID NO: 10224 - RNA, 20 nt, Homo sapiens
cugucaccaccagcuccagg

SEQ ID NO: 10225 - RNA, 20 nt, Homo sapiens
ccugucaccaccagcuccag

SEQ ID NO: 10226 - RNA, 20 nt, Homo sapiens
accugucaccaccagcucca

SEQ ID NO: 10227 - RNA, 20 nt, Homo sapiens
caccugucaccaccagcucc

SEQ ID NO: 10228 - RNA, 20 nt, Homo sapiens
cucagcccagcccagccccg

SEQ ID NO: 10229 - RNA, 20 nt, Homo sapiens
cccagccccguggugaacuc

SEQ ID NO: 10230 - RNA, 20 nt, Homo sapiens
agccccguggugaacucagg

SEQ ID NO: 10231 - RNA, 20 nt, Homo sapiens
gccccguggugaacucagga

SEQ ID NO: 10232 - RNA, 20 nt, Homo sapiens
aacccuccagugugacucac

SEQ ID NO: 10233 - RNA, 20 nt, Homo sapiens
ccuccagugugacucacagg

SEQ ID NO: 10234 - RNA, 20 nt, Homo sapiens
gacucacagguggcauuuga

SEQ ID NO: 10235 - RNA, 20 nt, Homo sapiens
ugauggcuucauucugugua

SEQ ID NO: 10236 - RNA, 20 nt, Homo sapiens
ggcuucauucuguguaagga

SEQ ID NO: 10237 - RNA, 20 nt, Homo sapiens
aacucccagccccaugcccg

SEQ ID NO: 10238 - RNA, 20 nt, Homo sapiens
acucccagccccaugcccgu

SEQ ID NO: 10239 - RNA, 20 nt, Homo sapiens
gucccgcgccaucuucuccg

SEQ ID NO: 10240 - RNA, 20 nt, Homo sapiens
ucccgcgccaucuucuccgu

SEQ ID NO: 10241 - RNA, 20 nt, Homo sapiens
gccccgugagcccgagucgc

SEQ ID NO: 10242 - RNA, 20 nt, Homo sapiens
ccgugagcccgagucgcagg

SEQ ID NO: 10243 - RNA, 20 nt, Homo sapiens
ugagcccgagucgcaggugg

SEQ ID NO: 10244 - RNA, 20 nt, Homo sapiens
cgagucgcagguggugguac

SEQ ID NO: 10245 - RNA, 20 nt, Homo sapiens
acucgaacucucccuaugag

SEQ ID NO: 10246 - RNA, 20 nt, Homo sapiens
gucucuacccagugaucucc

SEQ ID NO: 10247 - RNA, 20 nt, Homo sapiens
cagugaucuccuggagcucc

SEQ ID NO: 10248 - RNA, 20 nt, Homo sapiens
cuccuggagcuccugguccu

SEQ ID NO: 10249 - RNA, 20 nt, Homo sapiens
uaggcuccuaggagagaagg

SEQ ID NO: 10250 - RNA, 20 nt, Homo sapiens
auguaggcuccuaggagaga

SEQ ID NO: 10251 - RNA, 20 nt, Homo sapiens
uggguuugauguaggcuccu

SEQ ID NO: 10252 - RNA, 20 nt, Homo sapiens
ugagaggguggguuugaugu

SEQ ID NO: 10253 - RNA, 20 nt, Homo sapiens
cugggcugggcugagagggu

SEQ ID NO: 10254 - RNA, 20 nt, Homo sapiens
gcugggcugggcugagaggg

SEQ ID NO: 10255 - RNA, 20 nt, Homo sapiens
ggggcugggcugggcugaga

SEQ ID NO: 10256 - RNA, 20 nt, Homo sapiens
cggggcugggcugggcugag

SEQ ID NO: 10257 - RNA, 20 nt, Homo sapiens
guucaccacggggcugggcu

SEQ ID NO: 10258 - RNA, 20 nt, Homo sapiens
aguucaccacggggcugggc

SEQ ID NO: 10259 - RNA, 20 nt, Homo sapiens
ccugaguucaccacggggcu

SEQ ID NO: 10260 - RNA, 20 nt, Homo sapiens
uccugaguucaccacggggc

SEQ ID NO: 10261 - RNA, 20 nt, Homo sapiens
ucccuccugaguucaccacg

SEQ ID NO: 10262 - RNA, 20 nt, Homo sapiens
uucccuccugaguucaccac

SEQ ID NO: 10263 - RNA, 20 nt, Homo sapiens
auucccuccugaguucacca

SEQ ID NO: 10264 - RNA, 20 nt, Homo sapiens
caccugugagucacacugga

SEQ ID NO: 10265 - RNA, 20 nt, Homo sapiens
ccaccugugagucacacugg

SEQ ID NO: 10266 - RNA, 20 nt, Homo sapiens
augccaccugugagucacac

SEQ ID NO: 10267 - RNA, 20 nt, Homo sapiens
gcugggaguucaggcauugu

SEQ ID NO: 10268 - RNA, 20 nt, Homo sapiens
ggcugggaguucaggcauug

SEQ ID NO: 10269 - RNA, 20 nt, Homo sapiens
gggcauggggcugggaguuc

SEQ ID NO: 10270 - RNA, 20 nt, Homo sapiens
cgacccacgggcauggggcu

SEQ ID NO: 10271 - RNA, 20 nt, Homo sapiens
acgacccacgggcauggggc

SEQ ID NO: 10272 - RNA, 20 nt, Homo sapiens
cgggacgacccacgggcaug

SEQ ID NO: 10273 - RNA, 20 nt, Homo sapiens
gcgggacgacccacgggcau

SEQ ID NO: 10274 - RNA, 20 nt, Homo sapiens
cgcgggacgacccacgggca

SEQ ID NO: 10275 - RNA, 20 nt, Homo sapiens
gauggcgcgggacgacccac

SEQ ID NO: 10276 - RNA, 20 nt, Homo sapiens
agauggcgcgggacgaccca

SEQ ID NO: 10277 - RNA, 20 nt, Homo sapiens
gcccacggagaagauggcgc

SEQ ID NO: 10278 - RNA, 20 nt, Homo sapiens
ggcccacggagaagauggcg

SEQ ID NO: 10279 - RNA, 20 nt, Homo sapiens
cacggggcccacggagaaga

SEQ ID NO: 10280 - RNA, 20 nt, Homo sapiens
acucgggcucacggggccca

SEQ ID NO: 10281 - RNA, 20 nt, Homo sapiens
accugcgacucgggcucacg

SEQ ID NO: 10282 - RNA, 20 nt, Homo sapiens
caccugcgacucgggcucac

SEQ ID NO: 10283 - RNA, 20 nt, Homo sapiens
ccaccugcgacucgggcuca

SEQ ID NO: 10284 - RNA, 20 nt, Homo sapiens
uguaccaccaccugcgacuc

SEQ ID NO: 10285 - RNA, 20 nt, Homo sapiens
cuguaccaccaccugcgacu

SEQ ID NO: 10286 - RNA, 20 nt, Homo sapiens
cuggguagagaccacucaua

SEQ ID NO: 10287 - RNA, 20 nt, Homo sapiens
acuggguagagaccacucau

SEQ ID NO: 10288 - RNA, 20 nt, Homo sapiens
aggagcuccaggagaucacu

SEQ ID NO: 10289 - RNA, 20 nt, Homo sapiens
caggagcuccaggagaucac

SEQ ID NO: 10290 - RNA, 20 nt, Homo sapiens
caccuaggaccaggagcucc

SEQ ID NO: 10291 - RNA, 20 nt, Homo sapiens
ugaauuucucaccuaggacc

SEQ ID NO: 10292 - RNA, 20 nt, Homo sapiens
augcugugaauuucucaccu

SEQ ID NO: 10293 - RNA, 20 nt, Homo sapiens
ccaucacucucagugcagcc

SEQ ID NO: 10294 - RNA, 20 nt, Homo sapiens
agugcagccagguccuaucg

SEQ ID NO: 10295 - RNA, 20 nt, Homo sapiens
agguccuaucguggccccug

SEQ ID NO: 10296 - RNA, 20 nt, Homo sapiens
gagacccugacucugcagug

SEQ ID NO: 10297 - RNA, 20 nt, Homo sapiens
cugcaguguggcucugaugc

SEQ ID NO: 10298 - RNA, 20 nt, Homo sapiens
caacagauuuguucuguaua

SEQ ID NO: 10299 - RNA, 20 nt, Homo sapiens
agauuuguucuguauaagga

SEQ ID NO: 10300 - RNA, 20 nt, Homo sapiens
gauuuguucuguauaaggac

SEQ ID NO: 10301 - RNA, 20 nt, Homo sapiens
auuuguucuguauaaggacg

SEQ ID NO: 10302 - RNA, 20 nt, Homo sapiens
cgugacuuccuucagcucgc

SEQ ID NO: 10303 - RNA, 20 nt, Homo sapiens
gcucgcuggcgcacagcccc

SEQ ID NO: 10304 - RNA, 20 nt, Homo sapiens
gcuggcgcacagccccaggc

SEQ ID NO: 10305 - RNA, 20 nt, Homo sapiens
cuggcgcacagccccaggcu

SEQ ID NO: 10306 - RNA, 20 nt, Homo sapiens
gccccaggcugggcucuccc

SEQ ID NO: 10307 - RNA, 20 nt, Homo sapiens
cucccaggccaacuucaccc

SEQ ID NO: 10308 - RNA, 20 nt, Homo sapiens
ucccaggccaacuucacccu

SEQ ID NO: 10309 - RNA, 20 nt, Homo sapiens
ggcccugugagccgcuccua

SEQ ID NO: 10310 - RNA, 20 nt, Homo sapiens
gcccugugagccgcuccuac

SEQ ID NO: 10311 - RNA, 20 nt, Homo sapiens
cccugugagccgcuccuacg

SEQ ID NO: 10312 - RNA, 20 nt, Homo sapiens
ccugugagccgcuccuacgg

SEQ ID NO: 10313 - RNA, 20 nt, Homo sapiens
gggggccaguacagaugcua

SEQ ID NO: 10314 - RNA, 20 nt, Homo sapiens
cacacaaccucuccuccgag

SEQ ID NO: 10315 - RNA, 20 nt, Homo sapiens
caaccucuccuccgaguggu

SEQ ID NO: 10316 - RNA, 20 nt, Homo sapiens
gucggcccccagcgaccccc

SEQ ID NO: 10317 - RNA, 20 nt, Homo sapiens
ccccuggacauccugaucgc

SEQ ID NO: 10318 - RNA, 20 nt, Homo sapiens
ggacauccugaucgcaggug

SEQ ID NO: 10319 - RNA, 20 nt, Homo sapiens
aucgcaggugaggagcccag

SEQ ID NO: 10320 - RNA, 20 nt, Homo sapiens
ucgcaggugaggagcccagc

SEQ ID NO: 10321 - RNA, 20 nt, Homo sapiens
caccugggaaaaggugguca

SEQ ID NO: 10322 - RNA, 20 nt, Homo sapiens
uagaaacaccugggaaaagg

SEQ ID NO: 10323 - RNA, 20 nt, Homo sapiens
ucuuagaaacaccugggaaa

SEQ ID NO: 10324 - RNA, 20 nt, Homo sapiens
auggcuucuuagaaacaccu

SEQ ID NO: 10325 - RNA, 20 nt, Homo sapiens
gauggcuucuuagaaacacc

SEQ ID NO: 10326 - RNA, 20 nt, Homo sapiens
ccuggcugcacugagaguga

SEQ ID NO: 10327 - RNA, 20 nt, Homo sapiens
ucaggggccacgauaggacc

SEQ ID NO: 10328 - RNA, 20 nt, Homo sapiens
gucuccucaggggccacgau

SEQ ID NO: 10329 - RNA, 20 nt, Homo sapiens
cagagucagggucuccucag

SEQ ID NO: 10330 - RNA, 20 nt, Homo sapiens
gcagagucagggucuccuca

SEQ ID NO: 10331 - RNA, 20 nt, Homo sapiens
ugcagagucagggucuccuc

SEQ ID NO: 10332 - RNA, 20 nt, Homo sapiens
agagccacacugcagaguca

SEQ ID NO: 10333 - RNA, 20 nt, Homo sapiens
cagagccacacugcagaguc

SEQ ID NO: 10334 - RNA, 20 nt, Homo sapiens
gcugugcgccagcgagcuga

SEQ ID NO: 10335 - RNA, 20 nt, Homo sapiens
gccugggagagcccagccug

SEQ ID NO: 10336 - RNA, 20 nt, Homo sapiens
ggccugggagagcccagccu

SEQ ID NO: 10337 - RNA, 20 nt, Homo sapiens
uggccugggagagcccagcc

SEQ ID NO: 10338 - RNA, 20 nt, Homo sapiens
gcccagggugaaguuggccu

SEQ ID NO: 10339 - RNA, 20 nt, Homo sapiens
ggcccagggugaaguuggcc

SEQ ID NO: 10340 - RNA, 20 nt, Homo sapiens
cacagggcccagggugaagu

SEQ ID NO: 10341 - RNA, 20 nt, Homo sapiens
ggagcggcucacagggccca

SEQ ID NO: 10342 - RNA, 20 nt, Homo sapiens
aggagcggcucacagggccc

SEQ ID NO: 10343 - RNA, 20 nt, Homo sapiens
ccccguaggagcggcucaca

SEQ ID NO: 10344 - RNA, 20 nt, Homo sapiens
cccccguaggagcggcucac

SEQ ID NO: 10345 - RNA, 20 nt, Homo sapiens
uguacuggcccccguaggag

SEQ ID NO: 10346 - RNA, 20 nt, Homo sapiens
gcaucuguacuggcccccgu

SEQ ID NO: 10347 - RNA, 20 nt, Homo sapiens
gugcaccguagcaucuguac

SEQ ID NO: 10348 - RNA, 20 nt, Homo sapiens
gggccgaccacucggaggag

SEQ ID NO: 10349 - RNA, 20 nt, Homo sapiens
gcugggggccgaccacucgg

SEQ ID NO: 10350 - RNA, 20 nt, Homo sapiens
gucgcugggggccgaccacu

SEQ ID NO: 10351 - RNA, 20 nt, Homo sapiens
gauguccagggggucgcugg

SEQ ID NO: 10352 - RNA, 20 nt, Homo sapiens
ggauguccagggggucgcug

SEQ ID NO: 10353 - RNA, 20 nt, Homo sapiens
aggauguccagggggucgcu

SEQ ID NO: 10354 - RNA, 20 nt, Homo sapiens
caggauguccagggggucgc

SEQ ID NO: 10355 - RNA, 20 nt, Homo sapiens
cugcgaucaggauguccagg

SEQ ID NO: 10356 - RNA, 20 nt, Homo sapiens
ccugcgaucaggauguccag

SEQ ID NO: 10357 - RNA, 20 nt, Homo sapiens
accugcgaucaggaugucca

SEQ ID NO: 10358 - RNA, 20 nt, Homo sapiens
caccugcgaucaggaugucc

SEQ ID NO: 10359 - RNA, 20 nt, Homo sapiens
ugggcuccucaccugcgauc

SEQ ID NO: 10360 - RNA, 20 nt, Homo sapiens
cuaugacagagucucccucu

SEQ ID NO: 10361 - RNA, 20 nt, Homo sapiens
agucucccucucggugcagc

SEQ ID NO: 10362 - RNA, 20 nt, Homo sapiens
gucucccucucggugcagcc

SEQ ID NO: 10363 - RNA, 20 nt, Homo sapiens
cucggugcagccgggcccca

SEQ ID NO: 10364 - RNA, 20 nt, Homo sapiens
ggugcagccgggccccacgg

SEQ ID NO: 10365 - RNA, 20 nt, Homo sapiens
ccgggccccacgguggccuc

SEQ ID NO: 10366 - RNA, 20 nt, Homo sapiens
gacccugcugugucagucac

SEQ ID NO: 10367 - RNA, 20 nt, Homo sapiens
acccugcugugucagucaca

SEQ ID NO: 10368 - RNA, 20 nt, Homo sapiens
ugcugugucagucacaggga

SEQ ID NO: 10369 - RNA, 20 nt, Homo sapiens
gcaaacuuuccuucugacca

SEQ ID NO: 10370 - RNA, 20 nt, Homo sapiens
aacuuuccuucugaccaagg

SEQ ID NO: 10371 - RNA, 20 nt, Homo sapiens
acuuuccuucugaccaagga

SEQ ID NO: 10372 - RNA, 20 nt, Homo sapiens
cuuuccuucugaccaaggag

SEQ ID NO: 10373 - RNA, 20 nt, Homo sapiens
uuuccuucugaccaaggagg

SEQ ID NO: 10374 - RNA, 20 nt, Homo sapiens
agggggcagcugaugaccca

SEQ ID NO: 10375 - RNA, 20 nt, Homo sapiens
guaccaaucucaaaaauacc

SEQ ID NO: 10376 - RNA, 20 nt, Homo sapiens
auaccaggcugaauucccca

SEQ ID NO: 10377 - RNA, 20 nt, Homo sapiens
uaccaggcugaauuccccau

SEQ ID NO: 10378 - RNA, 20 nt, Homo sapiens
uccugugaccucagcccaug

SEQ ID NO: 10379 - RNA, 20 nt, Homo sapiens
ccugugaccucagcccaugc

SEQ ID NO: 10380 - RNA, 20 nt, Homo sapiens
cugugaccucagcccaugcg

SEQ ID NO: 10381 - RNA, 20 nt, Homo sapiens
cagcccaugcggggaccuac

SEQ ID NO: 10382 - RNA, 20 nt, Homo sapiens
gcggggaccuacaggugcua

SEQ ID NO: 10383 - RNA, 20 nt, Homo sapiens
gacucaccccagugaccccc

SEQ ID NO: 10384 - RNA, 20 nt, Homo sapiens
cagugacccccuggagcucg

SEQ ID NO: 10385 - RNA, 20 nt, Homo sapiens
ccccuggagcucguggucuc

SEQ ID NO: 10386 - RNA, 20 nt, Homo sapiens
cuggagcucguggucucagg

SEQ ID NO: 10387 - RNA, 20 nt, Homo sapiens
uggagcucguggucucaggu

SEQ ID NO: 10388 - RNA, 20 nt, Homo sapiens
ggagcucguggucucaggug

SEQ ID NO: 10389 - RNA, 20 nt, Homo sapiens
gagcucguggucucaggugg

SEQ ID NO: 10390 - RNA, 20 nt, Homo sapiens
guccuggagagaagaaggau

SEQ ID NO: 10391 - RNA, 20 nt, Homo sapiens
uguccuggagagaagaagga

SEQ ID NO: 10392 - RNA, 20 nt, Homo sapiens
gaacuguccuggagagaaga

SEQ ID NO: 10393 - RNA, 20 nt, Homo sapiens
acucugucauagaacugucc

SEQ ID NO: 10394 - RNA, 20 nt, Homo sapiens
ggggcccggcugcaccgaga

SEQ ID NO: 10395 - RNA, 20 nt, Homo sapiens
uggggcccggcugcaccgag

SEQ ID NO: 10396 - RNA, 20 nt, Homo sapiens
ccugaggccaccguggggcc

SEQ ID NO: 10397 - RNA, 20 nt, Homo sapiens
ucucuccugaggccaccgug

SEQ ID NO: 10398 - RNA, 20 nt, Homo sapiens
uucucuccugaggccaccgu

SEQ ID NO: 10399 - RNA, 20 nt, Homo sapiens
guucucuccugaggccaccg

SEQ ID NO: 10400 - RNA, 20 nt, Homo sapiens
cagggucacguucucuccug

SEQ ID NO: 10401 - RNA, 20 nt, Homo sapiens
ucccugugacugacacagca

SEQ ID NO: 10402 - RNA, 20 nt, Homo sapiens
aucccugugacugacacagc

SEQ ID NO: 10403 - RNA, 20 nt, Homo sapiens
cugcccccuccuuggucaga

SEQ ID NO: 10404 - RNA, 20 nt, Homo sapiens
gucaucagcugcccccuccu

SEQ ID NO: 10405 - RNA, 20 nt, Homo sapiens
acguugaucuuagacgccau

SEQ ID NO: 10406 - RNA, 20 nt, Homo sapiens
uacguugaucuuagacgcca

SEQ ID NO: 10407 - RNA, 20 nt, Homo sapiens
cagccugguauuuuugagau

SEQ ID NO: 10408 - RNA, 20 nt, Homo sapiens
gacccauggggaauucagcc

SEQ ID NO: 10409 - RNA, 20 nt, Homo sapiens
cugaggucacaggacccaug

SEQ ID NO: 10410 - RNA, 20 nt, Homo sapiens
gcugaggucacaggacccau

SEQ ID NO: 10411 - RNA, 20 nt, Homo sapiens
ggcugaggucacaggaccca

SEQ ID NO: 10412 - RNA, 20 nt, Homo sapiens
cccgcaugggcugaggucac

SEQ ID NO: 10413 - RNA, 20 nt, Homo sapiens
guagguccccgcaugggcug

SEQ ID NO: 10414 - RNA, 20 nt, Homo sapiens
gcaccuguagguccccgcau

SEQ ID NO: 10415 - RNA, 20 nt, Homo sapiens
agcaccuguagguccccgca

SEQ ID NO: 10416 - RNA, 20 nt, Homo sapiens
cugugagccguagcaccugu

SEQ ID NO: 10417 - RNA, 20 nt, Homo sapiens
gugagucagcagguaggguu

SEQ ID NO: 10418 - RNA, 20 nt, Homo sapiens
cuggggugagucagcaggua

SEQ ID NO: 10419 - RNA, 20 nt, Homo sapiens
acuggggugagucagcaggu

SEQ ID NO: 10420 - RNA, 20 nt, Homo sapiens
ggucacuggggugagucagc

SEQ ID NO: 10421 - RNA, 20 nt, Homo sapiens
cgagcuccagggggucacug

SEQ ID NO: 10422 - RNA, 20 nt, Homo sapiens
acgagcuccagggggucacu

SEQ ID NO: 10423 - RNA, 20 nt, Homo sapiens
cacgagcuccagggggucac

SEQ ID NO: 10424 - RNA, 20 nt, Homo sapiens
cugagaccacgagcuccagg

SEQ ID NO: 10425 - RNA, 20 nt, Homo sapiens
ccugagaccacgagcuccag

SEQ ID NO: 10426 - RNA, 20 nt, Homo sapiens
accugagaccacgagcucca

SEQ ID NO: 10427 - RNA, 20 nt, Homo sapiens
caccugagaccacgagcucc

SEQ ID NO: 10428 - RNA, 20 nt, Homo sapiens
uucuuuuacccaggaccguc

SEQ ID NO: 10429 - RNA, 20 nt, Homo sapiens
ucuuuuacccaggaccgucu

SEQ ID NO: 10430 - RNA, 20 nt, Homo sapiens
cuuuuacccaggaccgucug

SEQ ID NO: 10431 - RNA, 20 nt, Homo sapiens
uuuuacccaggaccgucugg

SEQ ID NO: 10432 - RNA, 20 nt, Homo sapiens
ggccccagcuccccgacaac

SEQ ID NO: 10433 - RNA, 20 nt, Homo sapiens
acaggccccaccuccacauc

SEQ ID NO: 10434 - RNA, 20 nt, Homo sapiens
ccacaucuggugagucccug

SEQ ID NO: 10435 - RNA, 20 nt, Homo sapiens
guccuggguaaaagaaugag

SEQ ID NO: 10436 - RNA, 20 nt, Homo sapiens
uggggcccccagacgguccu

SEQ ID NO: 10437 - RNA, 20 nt, Homo sapiens
cuggggcccccagacggucc

SEQ ID NO: 10438 - RNA, 20 nt, Homo sapiens
ggggagcuggggcccccaga

SEQ ID NO: 10439 - RNA, 20 nt, Homo sapiens
ggccuguugucggggagcug

SEQ ID NO: 10440 - RNA, 20 nt, Homo sapiens
gggccuguugucggggagcu

SEQ ID NO: 10441 - RNA, 20 nt, Homo sapiens
ggggccuguugucggggagc

SEQ ID NO: 10442 - RNA, 20 nt, Homo sapiens
ggagguggggccuguugucg

SEQ ID NO: 10443 - RNA, 20 nt, Homo sapiens
uggagguggggccuguuguc

SEQ ID NO: 10444 - RNA, 20 nt, Homo sapiens
guggagguggggccuguugu

SEQ ID NO: 10445 - RNA, 20 nt, Homo sapiens
acucaccagauguggaggug

SEQ ID NO: 10446 - RNA, 20 nt, Homo sapiens
gacucaccagauguggaggu

SEQ ID NO: 10447 - RNA, 20 nt, Homo sapiens
ggacucaccagauguggagg

SEQ ID NO: 10448 - RNA, 20 nt, Homo sapiens
cagggacucaccagaugugg

SEQ ID NO: 10449 - RNA, 20 nt, Homo sapiens
ccucagggacucaccagaug

SEQ ID NO: 10450 - RNA, 20 nt, Homo sapiens
ccuccccguccugacccagc

SEQ ID NO: 10451 - RNA, 20 nt, Homo sapiens
uccugacccagcaggcccug

SEQ ID NO: 10452 - RNA, 20 nt, Homo sapiens
gaccagccccucacccccac

SEQ ID NO: 10453 - RNA, 20 nt, Homo sapiens
accagccccucacccccacc

SEQ ID NO: 10454 - RNA, 20 nt, Homo sapiens
gccccucacccccaccgggu

SEQ ID NO: 10455 - RNA, 20 nt, Homo sapiens
accgggucggauccccagag

SEQ ID NO: 10456 - RNA, 20 nt, Homo sapiens
auccccagaguggugaguga

SEQ ID NO: 10457 - RNA, 20 nt, Homo sapiens
uccccagaguggugagugac

SEQ ID NO: 10458 - RNA, 20 nt, Homo sapiens
ggugagugacgggcucugag

SEQ ID NO: 10459 - RNA, 20 nt, Homo sapiens
gugagugacgggcucugagu

SEQ ID NO: 10460 - RNA, 20 nt, Homo sapiens
agugacgggcucugaguggg

SEQ ID NO: 10461 - RNA, 20 nt, Homo sapiens
gacgggcucugagugggagg

SEQ ID NO: 10462 - RNA, 20 nt, Homo sapiens
acgggcucugagugggaggu

SEQ ID NO: 10463 - RNA, 20 nt, Homo sapiens
gcucugagugggaggugggc

SEQ ID NO: 10464 - RNA, 20 nt, Homo sapiens
cucugagugggaggugggca

SEQ ID NO: 10465 - RNA, 20 nt, Homo sapiens
ccugcugggucaggacgggg

SEQ ID NO: 10466 - RNA, 20 nt, Homo sapiens
gggccugcugggucaggacg

SEQ ID NO: 10467 - RNA, 20 nt, Homo sapiens
agggccugcugggucaggac

SEQ ID NO: 10468 - RNA, 20 nt, Homo sapiens
cagggccugcugggucagga

SEQ ID NO: 10469 - RNA, 20 nt, Homo sapiens
uccucagggccugcuggguc

SEQ ID NO: 10470 - RNA, 20 nt, Homo sapiens
gcugguccucagggccugcu

SEQ ID NO: 10471 - RNA, 20 nt, Homo sapiens
ggcugguccucagggccugc

SEQ ID NO: 10472 - RNA, 20 nt, Homo sapiens
gggugaggggcugguccuca

SEQ ID NO: 10473 - RNA, 20 nt, Homo sapiens
ggggugaggggcugguccuc

SEQ ID NO: 10474 - RNA, 20 nt, Homo sapiens
acccggugggggugaggggc

SEQ ID NO: 10475 - RNA, 20 nt, Homo sapiens
uccgacccggugggggugag

SEQ ID NO: 10476 - RNA, 20 nt, Homo sapiens
auccgacccgguggggguga

SEQ ID NO: 10477 - RNA, 20 nt, Homo sapiens
gauccgacccggugggggug

SEQ ID NO: 10478 - RNA, 20 nt, Homo sapiens
cuggggauccgacccggugg

SEQ ID NO: 10479 - RNA, 20 nt, Homo sapiens
ucuggggauccgacccggug

SEQ ID NO: 10480 - RNA, 20 nt, Homo sapiens
cucuggggauccgacccggu

SEQ ID NO: 10481 - RNA, 20 nt, Homo sapiens
acucuggggauccgacccgg

SEQ ID NO: 10482 - RNA, 20 nt, Homo sapiens
accacucuggggauccgacc

SEQ ID NO: 10483 - RNA, 20 nt, Homo sapiens
gcccgucacucaccacucug

SEQ ID NO: 10484 - RNA, 20 nt, Homo sapiens
agcccgucacucaccacucu

SEQ ID NO: 10485 - RNA, 20 nt, Homo sapiens
gagcccgucacucaccacuc

SEQ ID NO: 10486 - RNA, 20 nt, Homo sapiens
cuuggguggggacggagggc

SEQ ID NO: 10487 - RNA, 20 nt, Homo sapiens
acaucaucgugcucaagguc

SEQ ID NO: 10488 - RNA, 20 nt, Homo sapiens
caucaucgugcucaaggucu

SEQ ID NO: 10489 - RNA, 20 nt, Homo sapiens
aucgugcucaaggucuggga

SEQ ID NO: 10490 - RNA, 20 nt, Homo sapiens
ucaaggucugggaaggcacc

SEQ ID NO: 10491 - RNA, 20 nt, Homo sapiens
caaggucugggaaggcaccu

SEQ ID NO: 10492 - RNA, 20 nt, Homo sapiens
aaggucugggaaggcaccug

SEQ ID NO: 10493 - RNA, 20 nt, Homo sapiens
aggucugggaaggcaccugg

SEQ ID NO: 10494 - RNA, 20 nt, Homo sapiens
aggcaccuggggguugugau

SEQ ID NO: 10495 - RNA, 20 nt, Homo sapiens
ggggguugugaucggcaucu

SEQ ID NO: 10496 - RNA, 20 nt, Homo sapiens
gguugugaucggcaucuugg

SEQ ID NO: 10497 - RNA, 20 nt, Homo sapiens
cauccuccgacaucgacguc

SEQ ID NO: 10498 - RNA, 20 nt, Homo sapiens
auccuccgacaucgacguca

SEQ ID NO: 10499 - RNA, 20 nt, Homo sapiens
aucgacgucagggcaaacac

SEQ ID NO: 10500 - RNA, 20 nt, Homo sapiens
acacuggacaucgagugagu

SEQ ID NO: 10501 - RNA, 20 nt, Homo sapiens
cacuggacaucgagugagua

SEQ ID NO: 10502 - RNA, 20 nt, Homo sapiens
gacaucgagugaguagggaa

SEQ ID NO: 10503 - RNA, 20 nt, Homo sapiens
acaucgagugaguagggaau

SEQ ID NO: 10504 - RNA, 20 nt, Homo sapiens
caucgagugaguagggaaug

SEQ ID NO: 10505 - RNA, 20 nt, Homo sapiens
aucgagugaguagggaaugg

SEQ ID NO: 10506 - RNA, 20 nt, Homo sapiens
ucgagugaguagggaauggg

SEQ ID NO: 10507 - RNA, 20 nt, Homo sapiens
agaugccgaucacaaccccc

SEQ ID NO: 10508 - RNA, 20 nt, Homo sapiens
cuccuccuccaguaggauga

SEQ ID NO: 10509 - RNA, 20 nt, Homo sapiens
ccuccuccuccuccuccagu

SEQ ID NO: 10510 - RNA, 20 nt, Homo sapiens
ucuucccccagcccagagaa

SEQ ID NO: 10511 - RNA, 20 nt, Homo sapiens
gcugauuuccaacauccugc

SEQ ID NO: 10512 - RNA, 20 nt, Homo sapiens
cugauuuccaacauccugca

SEQ ID NO: 10513 - RNA, 20 nt, Homo sapiens
ugauuuccaacauccugcag

SEQ ID NO: 10514 - RNA, 20 nt, Homo sapiens
ccaacauccugcaggggcug

SEQ ID NO: 10515 - RNA, 20 nt, Homo sapiens
caacauccugcaggggcugu

SEQ ID NO: 10516 - RNA, 20 nt, Homo sapiens
aacauccugcaggggcugug

SEQ ID NO: 10517 - RNA, 20 nt, Homo sapiens
gggccagagcccacagacag

SEQ ID NO: 10518 - RNA, 20 nt, Homo sapiens
ccacagacagaggccugcag

SEQ ID NO: 10519 - RNA, 20 nt, Homo sapiens
cagacagaggccugcagugg

SEQ ID NO: 10520 - RNA, 20 nt, Homo sapiens
uucucugggcugggggaaga

SEQ ID NO: 10521 - RNA, 20 nt, Homo sapiens
ucagccuuucucugggcugg

SEQ ID NO: 10522 - RNA, 20 nt, Homo sapiens
aucagccuuucucugggcug

SEQ ID NO: 10523 - RNA, 20 nt, Homo sapiens
aaucagccuuucucugggcu

SEQ ID NO: 10524 - RNA, 20 nt, Homo sapiens
aaaucagccuuucucugggc

SEQ ID NO: 10525 - RNA, 20 nt, Homo sapiens
uuggaaaucagccuuucucu

SEQ ID NO: 10526 - RNA, 20 nt, Homo sapiens
guuggaaaucagccuuucuc

SEQ ID NO: 10527 - RNA, 20 nt, Homo sapiens
ccacagccccugcaggaugu

SEQ ID NO: 10528 - RNA, 20 nt, Homo sapiens
ucuggccccacagccccugc

SEQ ID NO: 10529 - RNA, 20 nt, Homo sapiens
aggccucugucugugggcuc

SEQ ID NO: 10530 - RNA, 20 nt, Homo sapiens
cacugcaggccucugucugu

SEQ ID NO: 10531 - RNA, 20 nt, Homo sapiens
ccacugcaggccucugucug

SEQ ID NO: 10532 - RNA, 20 nt, Homo sapiens
ggcagaauuaccuccacugc

SEQ ID NO: 10533 - RNA, 20 nt, Homo sapiens
cagcccagcugccgaugccc

SEQ ID NO: 10534 - RNA, 20 nt, Homo sapiens
agaaaaccucugugagugag

SEQ ID NO: 10535 - RNA, 20 nt, Homo sapiens
ccucugugagugagaggaag

SEQ ID NO: 10536 - RNA, 20 nt, Homo sapiens
gcuggaccugggggaagaau

SEQ ID NO: 10537 - RNA, 20 nt, Homo sapiens
ggcuggaccugggggaagaa

SEQ ID NO: 10538 - RNA, 20 nt, Homo sapiens
ggcagcugggcuggaccugg

SEQ ID NO: 10539 - RNA, 20 nt, Homo sapiens
cggcagcugggcuggaccug

SEQ ID NO: 10540 - RNA, 20 nt, Homo sapiens
ucggcagcugggcuggaccu

SEQ ID NO: 10541 - RNA, 20 nt, Homo sapiens
aucggcagcugggcuggacc

SEQ ID NO: 10542 - RNA, 20 nt, Homo sapiens
cugggcaucggcagcugggc

SEQ ID NO: 10543 - RNA, 20 nt, Homo sapiens
cuuccugggcaucggcagcu

SEQ ID NO: 10544 - RNA, 20 nt, Homo sapiens
ucuuccugggcaucggcagc

SEQ ID NO: 10545 - RNA, 20 nt, Homo sapiens
gagguuuucuuccugggcau

SEQ ID NO: 10546 - RNA, 20 nt, Homo sapiens
cucacagagguuuucuuccu

SEQ ID NO: 10547 - RNA, 20 nt, Homo sapiens
acucacagagguuuucuucc

SEQ ID NO: 10548 - RNA, 20 nt, Homo sapiens
ccucuuccucucacucacag

SEQ ID NO: 10549 - RNA, 20 nt, Homo sapiens
cgugaagcacacacagccug

SEQ ID NO: 10550 - RNA, 20 nt, Homo sapiens
aagcacacacagccugagga

SEQ ID NO: 10551 - RNA, 20 nt, Homo sapiens
agcacacacagccugaggau

SEQ ID NO: 10552 - RNA, 20 nt, Homo sapiens
gcacacacagccugaggaug

SEQ ID NO: 10553 - RNA, 20 nt, Homo sapiens
cacacagccugaggaugggg

SEQ ID NO: 10554 - RNA, 20 nt, Homo sapiens
gccugaggaugggguggaga

SEQ ID NO: 10555 - RNA, 20 nt, Homo sapiens
augggguggagauggacacu

SEQ ID NO: 10556 - RNA, 20 nt, Homo sapiens
ugggguggagauggacacuc

SEQ ID NO: 10557 - RNA, 20 nt, Homo sapiens
caucugcuggggcagagcaa

SEQ ID NO: 10558 - RNA, 20 nt, Homo sapiens
gcaucugcuggggcagagca

SEQ ID NO: 10559 - RNA, 20 nt, Homo sapiens
cuucacggcagcaucugcug

SEQ ID NO: 10560 - RNA, 20 nt, Homo sapiens
gcuucacggcagcaucugcu

SEQ ID NO: 10561 - RNA, 20 nt, Homo sapiens
ugcuucacggcagcaucugc

SEQ ID NO: 10562 - RNA, 20 nt, Homo sapiens
cucaggcugugugugcuuca

SEQ ID NO: 10563 - RNA, 20 nt, Homo sapiens
uccaucuccaccccauccuc

SEQ ID NO: 10564 - RNA, 20 nt, Homo sapiens
cccacacgaugaagaccccc

SEQ ID NO: 10565 - RNA, 20 nt, Homo sapiens
ccaggcagugacguaugccg

SEQ ID NO: 10566 - RNA, 20 nt, Homo sapiens
aggugaaacacuccagaccu

SEQ ID NO: 10567 - RNA, 20 nt, Homo sapiens
cuccagaccuaggagagaaa

SEQ ID NO: 10568 - RNA, 20 nt, Homo sapiens
ucuccuccuuccccacuguc

SEQ ID NO: 10569 - RNA, 20 nt, Homo sapiens
cuccuccuuccccacugucu

SEQ ID NO: 10570 - RNA, 20 nt, Homo sapiens
uccuccuuccccacugucug

SEQ ID NO: 10571 - RNA, 20 nt, Homo sapiens
cccacugucuggggaauucc

SEQ ID NO: 10572 - RNA, 20 nt, Homo sapiens
uggggaauuccuggacacaa

SEQ ID NO: 10573 - RNA, 20 nt, Homo sapiens
ccuggacacaaaggacagac

SEQ ID NO: 10574 - RNA, 20 nt, Homo sapiens
ggacacaaaggacagacagg

SEQ ID NO: 10575 - RNA, 20 nt, Homo sapiens
aaaggacagacaggcggaag

SEQ ID NO: 10576 - RNA, 20 nt, Homo sapiens
acagacaggcggaagaggac

SEQ ID NO: 10577 - RNA, 20 nt, Homo sapiens
ggcggaagaggacaggcaga

SEQ ID NO: 10578 - RNA, 20 nt, Homo sapiens
ggacaggcagauggacacug

SEQ ID NO: 10579 - RNA, 20 nt, Homo sapiens
cugcuggagagagacagugg

SEQ ID NO: 10580 - RNA, 20 nt, Homo sapiens
gcucugcuggagagagacag

SEQ ID NO: 10581 - RNA, 20 nt, Homo sapiens
cuucaucgugugggcucugc

SEQ ID NO: 10582 - RNA, 20 nt, Homo sapiens
ccugggggucuucaucgugu

SEQ ID NO: 10583 - RNA, 20 nt, Homo sapiens
gccugggggucuucaucgug

SEQ ID NO: 10584 - RNA, 20 nt, Homo sapiens
cggcauacgucacugccugg

SEQ ID NO: 10585 - RNA, 20 nt, Homo sapiens
ucggcauacgucacugccug

SEQ ID NO: 10586 - RNA, 20 nt, Homo sapiens
cucggcauacgucacugccu

SEQ ID NO: 10587 - RNA, 20 nt, Homo sapiens
ccucggcauacgucacugcc

SEQ ID NO: 10588 - RNA, 20 nt, Homo sapiens
aggucuggaguguuucaccu

SEQ ID NO: 10589 - RNA, 20 nt, Homo sapiens
ggccauuucucuccuagguc

SEQ ID NO: 10590 - RNA, 20 nt, Homo sapiens
ggagaggccauuucucuccu

SEQ ID NO: 10591 - RNA, 20 nt, Homo sapiens
agacaguggggaaggaggag

SEQ ID NO: 10592 - RNA, 20 nt, Homo sapiens
uccccagacaguggggaagg

SEQ ID NO: 10593 - RNA, 20 nt, Homo sapiens
aauuccccagacagugggga

SEQ ID NO: 10594 - RNA, 20 nt, Homo sapiens
caggaauuccccagacagug

SEQ ID NO: 10595 - RNA, 20 nt, Homo sapiens
ccaggaauuccccagacagu

SEQ ID NO: 10596 - RNA, 20 nt, Homo sapiens
uccaggaauuccccagacag

SEQ ID NO: 10597 - RNA, 20 nt, Homo sapiens
ccugucuguccuuugugucc

SEQ ID NO: 10598 - RNA, 20 nt, Homo sapiens
ugcugcaucugaagcccccc

SEQ ID NO: 10599 - RNA, 20 nt, Homo sapiens
ugcacagcuugacccucaga

SEQ ID NO: 10600 - RNA, 20 nt, Homo sapiens
gcacagcuugacccucagac

SEQ ID NO: 10601 - RNA, 20 nt, Homo sapiens
cagcuugacccucagacggg

SEQ ID NO: 10602 - RNA, 20 nt, Homo sapiens
aacugagccuccuccauccc

SEQ ID NO: 10603 - RNA, 20 nt, Homo sapiens
gagccuccuccaucccagga

SEQ ID NO: 10604 - RNA, 20 nt, Homo sapiens
agccuccuccaucccaggaa

SEQ ID NO: 10605 - RNA, 20 nt, Homo sapiens
gcccagcaucuacgccacuc

SEQ ID NO: 10606 - RNA, 20 nt, Homo sapiens
cucuggccauccacuagccc

SEQ ID NO: 10607 - RNA, 20 nt, Homo sapiens
ucuggccauccacuagccca

SEQ ID NO: 10608 - RNA, 20 nt, Homo sapiens
cuggccauccacuagcccag

SEQ ID NO: 10609 - RNA, 20 nt, Homo sapiens
uggccauccacuagcccagg

SEQ ID NO: 10610 - RNA, 20 nt, Homo sapiens
ggccauccacuagcccaggg

SEQ ID NO: 10611 - RNA, 20 nt, Homo sapiens
gccauccacuagcccagggg

SEQ ID NO: 10612 - RNA, 20 nt, Homo sapiens
gacgcagaccccacacucca

SEQ ID NO: 10613 - RNA, 20 nt, Homo sapiens
accccacacuccauggaguc

SEQ ID NO: 10614 - RNA, 20 nt, Homo sapiens
uccauggagucuggaaugca

SEQ ID NO: 10615 - RNA, 20 nt, Homo sapiens
ccauggagucuggaaugcau

SEQ ID NO: 10616 - RNA, 20 nt, Homo sapiens
caugggagcugcccccccag

SEQ ID NO: 10617 - RNA, 20 nt, Homo sapiens
gcccccccaguggacaccau

SEQ ID NO: 10618 - RNA, 20 nt, Homo sapiens
ccauuggaccccacccagcc

SEQ ID NO: 10619 - RNA, 20 nt, Homo sapiens
acccagccuggaucuacccc

SEQ ID NO: 10620 - RNA, 20 nt, Homo sapiens
ggaucuaccccaggagacuc

SEQ ID NO: 10621 - RNA, 20 nt, Homo sapiens
gaucuaccccaggagacucu

SEQ ID NO: 10622 - RNA, 20 nt, Homo sapiens
aggagacucugggaacuuuu

SEQ ID NO: 10623 - RNA, 20 nt, Homo sapiens
ggagacucugggaacuuuua

SEQ ID NO: 10624 - RNA, 20 nt, Homo sapiens
gagacucugggaacuuuuag

SEQ ID NO: 10625 - RNA, 20 nt, Homo sapiens
gaugcagcagccugcagcgg

SEQ ID NO: 10626 - RNA, 20 nt, Homo sapiens
agaugcagcagccugcagcg

SEQ ID NO: 10627 - RNA, 20 nt, Homo sapiens
cagaugcagcagccugcagc

SEQ ID NO: 10628 - RNA, 20 nt, Homo sapiens
ucagaugcagcagccugcag

SEQ ID NO: 10629 - RNA, 20 nt, Homo sapiens
ggcguaggucacauccuggg

SEQ ID NO: 10630 - RNA, 20 nt, Homo sapiens
gggcguaggucacauccugg

SEQ ID NO: 10631 - RNA, 20 nt, Homo sapiens
ugggcguaggucacauccug

SEQ ID NO: 10632 - RNA, 20 nt, Homo sapiens
cugggcguaggucacauccu

SEQ ID NO: 10633 - RNA, 20 nt, Homo sapiens
gcugggcguaggucacaucc

SEQ ID NO: 10634 - RNA, 20 nt, Homo sapiens
caagcugugcagcugggcgu

SEQ ID NO: 10635 - RNA, 20 nt, Homo sapiens
gagggucaagcugugcagcu

SEQ ID NO: 10636 - RNA, 20 nt, Homo sapiens
ugagggucaagcugugcagc

SEQ ID NO: 10637 - RNA, 20 nt, Homo sapiens
cucaguugccucccgucuga

SEQ ID NO: 10638 - RNA, 20 nt, Homo sapiens
gcucaguugccucccgucug

SEQ ID NO: 10639 - RNA, 20 nt, Homo sapiens
ggcccuuccugggauggagg

SEQ ID NO: 10640 - RNA, 20 nt, Homo sapiens
gagggcccuuccugggaugg

SEQ ID NO: 10641 - RNA, 20 nt, Homo sapiens
ggagagggcccuuccuggga

SEQ ID NO: 10642 - RNA, 20 nt, Homo sapiens
agcuggagagggcccuuccu

SEQ ID NO: 10643 - RNA, 20 nt, Homo sapiens
cagcuggagagggcccuucc

SEQ ID NO: 10644 - RNA, 20 nt, Homo sapiens
augcugggcacagcuggaga

SEQ ID NO: 10645 - RNA, 20 nt, Homo sapiens
gaugcugggcacagcuggag

SEQ ID NO: 10646 - RNA, 20 nt, Homo sapiens
gcguagaugcugggcacagc

SEQ ID NO: 10647 - RNA, 20 nt, Homo sapiens
gccagaguggcguagaugcu

SEQ ID NO: 10648 - RNA, 20 nt, Homo sapiens
ggccagaguggcguagaugc

SEQ ID NO: 10649 - RNA, 20 nt, Homo sapiens
gggcuaguggauggccagag

SEQ ID NO: 10650 - RNA, 20 nt, Homo sapiens
ucccccccugggcuagugga

SEQ ID NO: 10651 - RNA, 20 nt, Homo sapiens
ugcgucccccccugggcuag

SEQ ID NO: 10652 - RNA, 20 nt, Homo sapiens
uggggucugcgucccccccu

SEQ ID NO: 10653 - RNA, 20 nt, Homo sapiens
guggggucugcguccccccc

SEQ ID NO: 10654 - RNA, 20 nt, Homo sapiens
uccagacuccauggagugug

SEQ ID NO: 10655 - RNA, 20 nt, Homo sapiens
uuccagacuccauggagugu

SEQ ID NO: 10656 - RNA, 20 nt, Homo sapiens
auuccagacuccauggagug

SEQ ID NO: 10657 - RNA, 20 nt, Homo sapiens
cccaugcauuccagacucca

SEQ ID NO: 10658 - RNA, 20 nt, Homo sapiens
uccaaugguguccacugggg

SEQ ID NO: 10659 - RNA, 20 nt, Homo sapiens
guccaaugguguccacuggg

SEQ ID NO: 10660 - RNA, 20 nt, Homo sapiens
gguccaaugguguccacugg

SEQ ID NO: 10661 - RNA, 20 nt, Homo sapiens
ggguccaaugguguccacug

SEQ ID NO: 10662 - RNA, 20 nt, Homo sapiens
gggguccaaugguguccacu

SEQ ID NO: 10663 - RNA, 20 nt, Homo sapiens
ugggguccaaugguguccac

SEQ ID NO: 10664 - RNA, 20 nt, Homo sapiens
ccaggcugggugggguccaa

SEQ ID NO: 10665 - RNA, 20 nt, Homo sapiens
ggguagauccaggcugggug

SEQ ID NO: 10666 - RNA, 20 nt, Homo sapiens
gggguagauccaggcugggu

SEQ ID NO: 10667 - RNA, 20 nt, Homo sapiens
ugggguagauccaggcuggg

SEQ ID NO: 10668 - RNA, 20 nt, Homo sapiens
uccugggguagauccaggcu

SEQ ID NO: 10669 - RNA, 20 nt, Homo sapiens
cuccugggguagauccaggc

SEQ ID NO: 10670 - RNA, 20 nt, Homo sapiens
gagucuccugggguagaucc

SEQ ID NO: 10671 - RNA, 20 nt, Homo sapiens
aaaguucccagagucuccug

SEQ ID NO: 10672 - RNA, 20 nt, Homo sapiens
aaaaguucccagagucuccu

SEQ ID NO: 10673 - RNA, 20 nt, Homo sapiens
uaaaaguucccagagucucc

SEQ ID NO: 10674 - protein, 448 aa, Artificial Sequence
  source: /note="Description of Artificial Sequence: Synthetic polypeptide"
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 10675 - DNA, 1353 bp, Artificial Sequence
  source: /note="Description of Artificial Sequence: Synthetic polynucleotide"
gccaccatgagcagatctgtggccctggctgtgctggccctgctgtctctgtctggcctggaagccatccagcggacccccaagatccaggtgtacagcagacaccccgccgaaaacggcaagagcaacttcctgaactgctacgtgtccggcttccaccccagcgacatcgaggtggacctgctgaagaacggcgagcggatcgaaaaggtggaacatagcgacctgagcttcagcaaggactggtccttctacctgctgtactacaccgagttcacccccaccgaaaaggacgagtacgcctgcagagtgaaccacgtgaccctgagccagcccaagatcgtgaagtgggaccgggatatgggcggaggcggatccggcggcggaggatcaggggggggagggtccggatcccacagcatgcggtacttctctgccgccgtgtccagacctggaagaggcgagccccggtttatcgccatgggctacgtggacgacacccagttcgtcagattcgacagcgacagcgcctgcccccggatggaacctagagcaccttgggtggaacaggaaggccccgagtactgggaggaagagacacggaacaccaaggcccacgcccagaccgacagaatgaacctgcagaccctgcggggctactacaaccagagcgaggccagcagccacaccctgcagtggatgatcggctgcgatctgggcagcgacggcagactgctgagaggttacgaacagtacgcctacgacggcaaggactacctggccctgaacgaggacctgcggtcttggacagccgccgatacagccgcccagatcagcaagagaaagtgcgaggccgccaacgtggccgagcagagaagggcttacctggaaggcacctgtgtggaatggctgcatagatacctggaaaacggcaaagagatgctgcagcgggccgacccccctaagacacacgtgacacaccaccccgtgttcgactacgaggccaccctgagatgttgggccctgggcttctatcctgccgagatcatcctgacctggcagagggatggcgaggaccagacccaggacgtggaactggtggaaaccagacctgccggcgacggcaccttccagaaatgggctgctgtggtggtgcccagcggcgaagaacagagatacacctgtcacgtgcagcacgagggcctgcccgaacccctgatgctgagatggaagcagagcagcctgcccaccatccccatcatgggaatcgtggccggactggtggtgctggccgctgtcgtgacaggcgctgcagtggccgccgtgctgtggcggaagaagtccagcgactaa

SEQ ID NO: 10676 - protein, 338 aa, Artificial Sequence [sequence omitted]

SEQ ID NO: 10677 - RNA, 20 nt, Homo sapiens
aggccucucuacuuccugug

SEQ ID NO: 10678 - RNA, 20 nt, Homo sapiens
ggccucucuacuuccugugu

SEQ ID NO: 10679 - RNA, 20 nt, Homo sapiens
gccucucuacuuccugugug

SEQ ID NO: 10680 - RNA, 20 nt, Homo sapiens
gacucugacaauaccuggag

SEQ ID NO: 10681 - RNA, 20 nt, Homo sapiens
ggacucugacaauaccugga

SEQ ID NO: 10682 - RNA, 20 nt, Homo sapiens
aagaggacucugacaauacc

SEQ ID NO: 10683 - RNA, 20 nt, Homo sapiens
uuccuagaaggccaaacaag

SEQ ID NO: 10684 - RNA, 20 nt, Homo sapiens
ggucccacagccuuccuaga

SEQ ID NO: 10685 - RNA, 20 nt, Homo sapiens
uggacugguugaagaaagcu

SEQ ID NO: 10686 - RNA, 20 nt, Homo sapiens
gcagaggccuccaccuggac

SEQ ID NO: 10687 - RNA, 20 nt, Homo sapiens
cuuggaaacguucaaggcag

SEQ ID NO: 10688 - RNA, 20 nt, Homo sapiens
accucacuuggaaacguuca

SEQ ID NO: 10689 - RNA, 20 nt, Homo sapiens
ccugcggguuuuaccucacu

SEQ ID NO: 10690 - RNA, 20 nt, Homo sapiens
agagaggccucugggccugc

SEQ ID NO: 10691 - RNA, 20 nt, Homo sapiens
caggaaguagagaggccucu

SEQ ID NO: 10692 - RNA, 20 nt, Homo sapiens
accccacacaggaaguagag

SEQ ID NO: 10693 - RNA, 20 nt, Homo sapiens
aggguuucugaaccccacac

SEQ ID NO: 10694 - RNA, 20 nt, Homo sapiens
ccugaggcugggaggggagg

SEQ ID NO: 10695 - RNA, 20 nt, Homo sapiens
ugaagcaggcaccugaggcu

SEQ ID NO: 10696 - RNA, 20 nt, Homo sapiens
cugaagcaggcaccugaggc

SEQ ID NO: 10697 - RNA, 20 nt, Homo sapiens
uuuucugaagcaggcaccug

SEQ ID NO: 10698 - RNA, 20 nt, Homo sapiens
uccagaaguaguaagucugc

SEQ ID NO: 10699 - RNA, 20 nt, Homo sapiens
ccaugaaacaaagaugcagu

SEQ ID NO: 10700 - RNA, 20 nt, Homo sapiens
caugaaacaaagaugcaguc

SEQ ID NO: 10701 - RNA, 20 nt, Homo sapiens
agaugcagucgggcacucac

SEQ ID NO: 10702 - RNA, 20 nt, Homo sapiens
gggcacucacuggagaguuc

SEQ ID NO: 10703 - RNA, 20 nt, Homo sapiens
ggcacucacuggagaguucu

SEQ ID NO: 10704 - RNA, 20 nt, Homo sapiens
uuacuuuacuaagauggcgg

SEQ ID NO: 10705 - RNA, 20 nt, Homo sapiens
cuguuacuuuacuaagaugg

SEQ ID NO: 10706 - RNA, 20 nt, Homo sapiens
ggacuguuacuuuacuaaga

SEQ ID NO: 10707 - RNA, 20 nt, Homo sapiens
cgacugcaucuuuguuucau

SEQ ID NO: 10708 - RNA, 20 nt, Homo sapiens
ccgacugcaucuuuguuuca

SEQ ID NO: 10709 - RNA, 20 nt, Homo sapiens
acucaccugauaagaggcag

SEQ ID NO: 10710 - RNA, 20 nt, Homo sapiens
cauccuacucaccugauaag

SEQ ID NO: 10711 - RNA, 20 nt, Homo sapiens
uuucuuauuuauuuucuagu

SEQ ID NO: 10712 - RNA, 20 nt, Homo sapiens
uuuauuuucuaguuggcguu

SEQ ID NO: 10713 - RNA, 20 nt, Homo sapiens
uuauuuucuaguuggcguuu

SEQ ID NO: 10714 - RNA, 20 nt, Homo sapiens
uauuuucuaguuggcguuug

SEQ ID NO: 10715 - RNA, 20 nt, Homo sapiens
auuuucuaguuggcguuugg

SEQ ID NO: 10716 - RNA, 20 nt, Homo sapiens
cuuuucagguaaugaagaaa

SEQ ID NO: 10717 - RNA, 20 nt, Homo sapiens
gcauauaaagucuccaucuc

SEQ ID NO: 10718 - RNA, 20 nt, Homo sapiens
uugacaugcccucaguaucc

SEQ ID NO: 10719 - RNA, 20 nt, Homo sapiens
auccuggaucugaaauacua

SEQ ID NO: 10720 - RNA, 20 nt, Homo sapiens
cacaaugauaaaaacauagg

SEQ ID NO: 10721 - RNA, 20 nt, Homo sapiens
uaaaaacauaggcggugaug

SEQ ID NO: 10722 - RNA, 20 nt, Homo sapiens
gaugaggaugauaaaaacau

SEQ ID NO: 10723 - RNA, 20 nt, Homo sapiens
uaaaaacauaggcagugaug

SEQ ID NO: 10724 - RNA, 20 nt, Homo sapiens
ugaggaucaccugucacuga

SEQ ID NO: 10725 - RNA, 20 nt, Homo sapiens
acugaaggaauuuucagaau

SEQ ID NO: 10726 - RNA, 20 nt, Homo sapiens
uuuucagaauuggagcaaag

SEQ ID NO: 10727 - RNA, 20 nt, Homo sapiens
gaacuuuuaucucuaccuga

SEQ ID NO: 10728 - RNA, 20 nt, Homo sapiens
uauuacugugguuccagaga

SEQ ID NO: 10729 - RNA, 20 nt, Homo sapiens
agggcaugucaauauuacug

SEQ ID NO: 10730 - RNA, 20 nt, Homo sapiens
uuucagauccaggauacuga

SEQ ID NO: 10731 - RNA, 20 nt, Homo sapiens
auuucagauccaggauacug

SEQ ID NO: 10732 - RNA, 20 nt, Homo sapiens
ugccauaguauuucagaucc

SEQ ID NO: 10733 - RNA, 20 nt, Homo sapiens
cugaaaauuccuucagugac

SEQ ID NO: 10734 - RNA, 20 nt, Homo sapiens
cuucugguuugcuuccucug

SEQ ID NO: 10735 - RNA, 20 nt, Homo sapiens
ucuucugguuugcuuccucu

SEQ ID NO: 10736 - RNA, 20 nt, Homo sapiens
aucuucugguuugcuuccuc

SEQ ID NO: 10737 - RNA, 20 nt, Homo sapiens
agauaaaaguucgcaucuuc

SEQ ID NO: 10738 - RNA, 20 nt, Homo sapiens
cuggauuaccucuugcccuc

SEQ ID NO: 10739 - RNA, 20 nt, Homo sapiens
cauggagauggaugugaugu

SEQ ID NO: 10740 - RNA, 20 nt, Homo sapiens
uaguggacaucugcaucacu

SEQ ID NO: 10741 - RNA, 20 nt, Homo sapiens
guggacaucugcaucacugg

SEQ ID NO: 10742 - RNA, 20 nt, Homo sapiens
cacugggggcuugcugcugc

SEQ ID NO: 10743 - RNA, 20 nt, Homo sapiens
cuacuggagcaagaauagaa

SEQ ID NO: 10744 - RNA, 20 nt, Homo sapiens
gagcaagaauagaaaggcca

SEQ ID NO: 10745 - RNA, 20 nt, Homo sapiens
aaggccaagccugugacacg

SEQ ID NO: 10746 - RNA, 20 nt, Homo sapiens
caagccugugacacgaggag

SEQ ID NO: 10747 - RNA, 20 nt, Homo sapiens
gauguccacuaugacaauug

SEQ ID NO: 10748 - RNA, 20 nt, Homo sapiens
ucgugucacaggcuuggccu

SEQ ID NO: 10749 - RNA, 20 nt, Homo sapiens
cgcuccucgugucacaggcu

SEQ ID NO: 10750 - RNA, 20 nt, Homo sapiens
gcacccgcuccucgugucac

SEQ ID NO: 10751 - RNA, 20 nt, Homo sapiens
ccgcaggacaaaacaaggag

SEQ ID NO: 10752 - RNA, 20 nt, Homo sapiens
ucuggguugggaacaggugg

SEQ ID NO: 10753 - RNA, 20 nt, Homo sapiens
uagucuggguugggaacagg

SEQ ID NO: 10754 - RNA, 20 nt, Homo sapiens
ucauagucuggguugggaac

SEQ ID NO: 10755 - RNA, 20 nt, Homo sapiens
guuaccucauagucuggguu

SEQ ID NO: 10756 - RNA, 20 nt, Homo sapiens
cguuaccucauagucugggu

SEQ ID NO: 10757 - RNA, 20 nt, Homo sapiens
cccacguuaccucauagucu

SEQ ID NO: 10758 - RNA, 20 nt, Homo sapiens
ucccacguuaccucauaguc

SEQ ID NO: 10759 - RNA, 20 nt, Homo sapiens
uauuucacccccagcccauc

SEQ ID NO: 10760 - RNA, 20 nt, Homo sapiens
cacccccagcccauccggaa

SEQ ID NO: 10761 - RNA, 20 nt, Homo sapiens
agcccauccggaaaggccag

SEQ ID NO: 10762 - RNA, 20 nt, Homo sapiens
gcccauccggaaaggccagc

SEQ ID NO: 10763 - RNA, 20 nt, Homo sapiens
ggccagcgggaccuguauuc

SEQ ID NO: 10764 - RNA, 20 nt, Homo sapiens
cagagacgcaucugacccuc

SEQ ID NO: 10765 - RNA, 20 nt, Homo sapiens
uuacacugauacaucccucg

SEQ ID NO: 10766 - RNA, 20 nt, Homo sapiens
gcauucuuuuaccucucgac

SEQ ID NO: 10767 - RNA, 20 nt, Homo sapiens
uacacugauacaucccucga

SEQ ID NO: 10768 - RNA, 20 nt, Homo sapiens
auacaucccucgaggguccu

SEQ ID NO: 10769 - RNA, 20 nt, Homo sapiens
uaccugguagagcuggucau

SEQ ID NO: 10770 - RNA, 20 nt, Homo sapiens
cgagggauguaucaguguaa

SEQ ID NO: 10771 - RNA, 20 nt, Homo sapiens
ggucuacuucauugcuggac

SEQ ID NO: 10772 - RNA, 20 nt, Homo sapiens
guaaugccaaggacccucga

SEQ ID NO: 10773 - RNA, 20 nt, Homo sapiens
accugguagagcuggucauu

SEQ ID NO: 10774 - RNA, 20 nt, Homo sapiens
gcauuuucguccuugcuguu

SEQ ID NO: 10775 - RNA, 20 nt, Homo sapiens
guuggggucuacuucauugc

SEQ ID NO: 10776 - RNA, 20 nt, Homo sapiens
gucaucuucucgauccuuga

SEQ ID NO: 10777 - RNA, 20 nt, Homo sapiens
ucaucuucucgauccuugag

SEQ ID NO: 10778 - RNA, 20 nt, Homo sapiens
guguaugacuaucaagaaga

SEQ ID NO: 10779 - RNA, 20 nt, Homo sapiens
uucaggaaaccacuugguua

SEQ ID NO: 10780 - RNA, 20 nt, Homo sapiens
acuucgauaaugaacuugca

SEQ ID NO: 10781 - RNA, 20 nt, Homo sapiens
agcaucaucucgaucucgga

SEQ ID NO: 10782 - RNA, 20 nt, Homo sapiens
gagcaucaucucgaucucgg

SEQ ID NO: 10783 - RNA, 20 nt, Homo sapiens
ggaccugggaaaacgcaucc

SEQ ID NO: 10784 - RNA, 20 nt, Homo sapiens
gacauuacaagacuggaccu

SEQ ID NO: 10785 - RNA, 20 nt, Homo sapiens
aaacgcauccuggacccacg

SEQ ID NO: 10786 - RNA, 20 nt, Homo sapiens
ggcgagaucccaagcaaguc

SEQ ID NO: 10787 - RNA, 20 nt, Homo sapiens
acugagcaucaucucgaucu

SEQ ID NO: 10788 - RNA, 20 nt, Homo sapiens
gcaucaucucgaucucggag

SEQ ID NO: 10789 - RNA, 20 nt, Homo sapiens
ccgacacacaagcucuguug

SEQ ID NO: 10790 - RNA, 20 nt, Homo sapiens
uacaccuauauauuccucgu

SEQ ID NO: 10791 - RNA, 20 nt, Homo sapiens
gauaccuauagaggaacuug

SEQ ID NO: 10792 - RNA, 20 nt, Homo sapiens
acaacucccacgccuugccc

SEQ ID NO: 10793 - RNA, 20 nt, Homo sapiens
uuacaccuauauauuccucg

SEQ ID NO: 10794 - RNA, 20 nt, Homo sapiens
ggaacaagugaaccugagac

SEQ ID NO: 10795 - protein, 6 aa, Artificial Sequence
  source: /note="Description of Artificial Sequence: Synthetic 6xHis tag"
HHHHHH

SEQ ID NO: 10796 - protein, 8 aa, Artificial Sequence
  source: /note="Description of Artificial Sequence: Synthetic 8xHis tag"
HHHHHHHH

SEQ ID NO: 10797 - RNA, 36 nt, Artificial Sequence
  source: /note="Description of Artificial Sequence: Synthetic oligonucleotide"
  modified_base (1)..(20): a, c, u, g, unknown or other
nnnnnnnnnnnnnnnnnnnnguuuuagagcuaugcu

SEQ ID NO: 10798 - RNA, 74 nt, Artificial Sequence; identical to SEQ ID NO: 6660
  source: /note="Description of Artificial Sequence: Synthetic oligonucleotide"

SEQ ID NO: 10799 - RNA, 100 nt, Artificial Sequence
  source: /note="Description of Artificial Sequence: Synthetic polynucleotide"
  modified_base (1)..(20): a, c, u, g, unknown or other
nnnnnnnnnnnnnnnnnnnnguuuuagagcuagaaauagcaaguuaaaauaaggcuaguccguuaucaacuugaaaaaguggcaccgagucggugcuuuu

SEQ ID NO: 10800 - protein, 10 aa, Artificial Sequence
  source: /note="Description of Artificial Sequence: Synthetic His tag"
  MISC_FEATURE (1)..(10): /note="This sequence may encompass 3-10 residues"
HHHHHHHHHH

SEQ ID NO: 10801 - protein, 30 aa, Artificial Sequence
  source: /note="Description of Artificial Sequence: Synthetic polypeptide"
  MISC_FEATURE (1)..(30): /note="This sequence may encompass 1-6 'Gly-Gly-Gly-Gly-Ser' repeating units"
GGGGSGGGGSGGGGSGGGGSGGGGSGGGGS

SEQ ID NO: 10802 - DNA, 63 bp, Artificial Sequence
  source: /note="Description of Artificial Sequence: Synthetic oligonucleotide"
atggccctccctgtcaccgccctgctgcttccgctggctcttctgctccacgccgctcggccc

SEQ ID NO: 10803 - DNA, 72 bp, Artificial Sequence
  source: /note="Description of Artificial Sequence: Synthetic oligonucleotide"
atctacatttgggcccctctggctggtacttgcggggtcctgctgctttcactcgtgatcactctttactgt

SEQ ID NO: 10804 - DNA, 126 bp, Artificial Sequence
  source: /note="Description of Artificial Sequence: Synthetic polynucleotide"
aagcgcggtcggaagaagctgctgtacatctttaagcaacccttcatgaggcctgtgcagactactcaagaggaggacggctgttcatgccggttcccagaggaggaggaaggcggctgcgaactg

SEQ ID NO: 10805 - DNA, 336 bp, Artificial Sequence
  source: /note="Description of Artificial Sequence: Synthetic polynucleotide"
cgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 10806 - RNA, 10 nt, Artificial Sequence
  source: /note="Description of Artificial Sequence: Synthetic oligonucleotide"
  misc_feature (1)..(10): /note="This sequence may encompass 1-10 nucleotides"
uuuuuuuuuu

SEQ ID NO: 10807 - DNA, 21 bp, Artificial Sequence
  source: /note="Description of Artificial Sequence: Synthetic primer"
cagacagcaaactcacccagt

SEQ ID NO: 10808 - DNA, 20 bp, Artificial Sequence
  source: /note="Description of Artificial Sequence: Synthetic primer"
ctgacgcttatcgacgccct

SEQ ID NO: 10809 - RNA, 10 nt, Artificial Sequence
  source: /note="Description of Artificial Sequence: Synthetic oligonucleotide"
  misc_feature (1)..(10): /note="This sequence may encompass 1-10 nucleotides"
aaaaaaaaaa

SEQ ID NO: 10810 - DNA, 33 bp, Artificial Sequence
  source: /note="Description of Artificial Sequence: Synthetic primer"
tcgtcggcagcgtcagatgtgtataagagacag

SEQ ID NO: 10811 - DNA, 34 bp, Artificial Sequence
  source: /note="Description of Artificial Sequence: Synthetic primer"
gtctcgtgggctcggagatgtgtataagagacag

SEQ ID NO: 10812 - DNA, 51 bp, Artificial Sequence
  source: /note="Description of Artificial Sequence: Synthetic primer"
  modified_base (30)..(37): a, c, t, g, unknown or other
aatgatacggcgaccaccgagatctacacnnnnnnnntcgtcggcagcgtc

SEQ ID NO: 10813 - DNA, 47 bp, Artificial Sequence
  source: /note="Description of Artificial Sequence: Synthetic primer"
  modified_base (25)..(32): a, c, t, g, unknown or other
caagcagaagacggcatacgagatnnnnnnnngtctcgtgggctcgg

SEQ ID NO: 10814 - DNA, 21 bp, Artificial Sequence
  source: /note="Description of Artificial Sequence: Synthetic primer"
caagcagaagacggcatacga

SEQ ID NO: 10815 - DNA, 22 bp, Artificial Sequence
  source: /note="Description of Artificial Sequence: Synthetic primer"
aatgatacggcgaccaccgaga

SEQ ID NO: 10816 - DNA, 23 bp, Homo sapiens
ggcaacagagcgagacaactggg

SEQ ID NO: 10817 - DNA, 23 bp, Homo sapiens
ggcgacagaacgagacatctcgg

SEQ ID NO: 10818 - DNA, 23 bp, Homo sapiens
aaagtcacacagctggtacatgg

SEQ ID NO: 10819 - DNA, 24 bp, Artificial Sequence
  source: /note="Description of Artificial Sequence: Synthetic primer"
gcacgcgtttaatataagtggagg

SEQ ID NO: 10820 - DNA, 21 bp, Artificial Sequence
  source: /note="Description of Artificial Sequence: Synthetic primer"
cctcatctgtgcagcgggcat

SEQ ID NO: 10821 - DNA, 20 bp, Artificial Sequence
  source: /note="Description of Artificial Sequence: Synthetic primer"
catcacgagcagctggtttc

SEQ ID NO: 10822 - DNA, 20 bp, Artificial Sequence
  source: /note="Description of Artificial Sequence: Synthetic primer"
gagccgaggtatcggtcctg

SEQ ID NO: 10823 - DNA, 24 bp, Artificial Sequence
  source: /note="Description of Artificial Sequence: Synthetic primer"
tgtttgtaaggggatatgcacaga

SEQ ID NO: 10824 - DNA, 24 bp, Artificial Sequence
  source: /note="Description of Artificial Sequence: Synthetic primer"
tgttgtaggtgtcaattttctgcc

SEQ ID NO: 10825 - DNA, 26 bp, Artificial Sequence
  source: /note="Description of Artificial Sequence: Synthetic primer"
ccctctttccagaaatttccttcttc

SEQ ID NO: 10826 - DNA, 24 bp, Artificial Sequence
  source: /note="Description of Artificial Sequence: Synthetic primer"
aatagagactcaccttgggctttc

SEQ ID NO: 10827 - DNA, 24 bp, Artificial Sequence
  source: /note="Description of Artificial Sequence: Synthetic primer"
gccttcagttagaccttgttgatt

SEQ ID NO: 10828 - DNA, 24 bp, Artificial Sequence
  source: /note="Description of Artificial Sequence: Synthetic primer"
tccttcttcatccaagggactttt

SEQ ID NO: 10829 - DNA, 24 bp, Artificial Sequence
  source: /note="Description of Artificial Sequence: Synthetic primer"
ttcttcatccaagggacttttcct

SEQ ID NO: 10830 - DNA, 24 bp, Artificial Sequence
  source: /note="Description of Artificial Sequence: Synthetic primer"
tgttgtaggtgtcaattttctgcc

SEQ ID NO: 10831 - DNA, 24 bp, Artificial Sequence
  source: /note="Description of Artificial Sequence: Synthetic primer"
tgtaggtgtcaattttctgcctct

SEQ ID NO: 10832 - DNA, 15 bp, Artificial Sequence
  source: /note="Description of Artificial Sequence: Synthetic primer"
gaccctcccgtcgcc

SEQ ID NO: 10833 - DNA, 23 bp, Artificial Sequence
  source: /note="Description of Artificial Sequence: Synthetic primer"
cgaggtactaggcagagccgtgg

SEQ ID NO: 10834 - DNA, 20 bp, Artificial Sequence
  source: /note="Description of Artificial Sequence: Synthetic primer"
ggactgccagaacaaggctc

SEQ ID NO: 10835 - DNA, 20 bp, Artificial Sequence
  source: /note="Description of Artificial Sequence: Synthetic primer"
attcaggagagaccccaccc

SEQ ID NO: 10836 - DNA, 24 bp, Artificial Sequence
  source: /note="Description of Artificial Sequence: Synthetic primer"
gtttcaggccattattattgcaca

SEQ ID NO: 10837 - DNA, 24 bp, Artificial Sequence
  source: /note="Description of Artificial Sequence: Synthetic primer"
aatttcccctgattgccgtctcta

SEQ ID NO: 10838 - DNA, 23 bp, Artificial Sequence
  source: /note="Description of Artificial Sequence: Synthetic primer"
gactgacgtggctcatgatgaat

SEQ ID NO: 10839 - DNA, 24 bp, Artificial Sequence
  source: /note="Description of Artificial Sequence: Synthetic primer"
gtacattttaaggctcctgttggc

SEQ ID NO: 10840 - DNA, 24 bp, Artificial Sequence
  source: /note="Description of Artificial Sequence: Synthetic primer"
gagtctctattgtacccaccttgg

SEQ ID NO: 10841 - DNA, 22 bp, Artificial Sequence
  source: /note="Description of Artificial Sequence: Synthetic primer"
cccttgcaatgatttctgtggg

SEQ ID NO: 10842 - DNA, 23 bp, Artificial Sequence
  source: /note="Description of Artificial Sequence: Synthetic primer"
gactgacgtggctcatgatgaat

SEQ ID NO: 10843 - DNA, 24 bp, Artificial Sequence
  source: /note="Description of Artificial Sequence: Synthetic primer"
aatttcccctgattgccgtctcta

SEQ ID NO: 10844 - DNA, 22 bp, Artificial Sequence
  source: /note="Description of Artificial Sequence: Synthetic primer"
gaatttcccctgattgccgtct

SEQ ID NO: 10845 - DNA, 78 bp, Artificial Sequence
  source: /note="Description of Artificial Sequence: Synthetic oligonucleotide"
ccctgatcctcttgtcccacagatatccagaaccctgaccctgccgtaccagctgagagactctaaatccagtgacaa

SEQ ID NO: 10846 - DNA, 79 bp, Artificial Sequence
  source: /note="Description of Artificial Sequence: Synthetic oligonucleotide"
ccctgatcctcttgtcccacagatatccagaaccctgaccctgcctgtaccagctgagagactctaaatccagtgacaa

SEQ ID NO: 10847 - DNA, 56 bp, Artificial Sequence
  source: /note="Description of Artificial Sequence: Synthetic oligonucleotide"
ccctgatcctcttgtcccacagatatccagctgagagactctaaatccagtgacaa

SEQ ID NO: 10848 - DNA, 68 bp, Artificial Sequence
  source: /note="Description of Artificial Sequence: Synthetic oligonucleotide"
ccctgatcctcttgtcccacagatatccagaaccctgaccagctgagagactctaaatccagtgacaa

SEQ ID NO: 10849 - DNA, 60 bp, Artificial Sequence
  source: /note="Description of Artificial Sequence: Synthetic oligonucleotide"
ccctgatcctcttgtcccacagatatccagaaccctgagagactctaaatccagtgacaa

SEQ ID NO: 10850 - DNA, 81 bp, Artificial Sequence
  source: /note="Description of Artificial Sequence: Synthetic oligonucleotide"
gatcctcttgtcccacagatatccagaaccctgaccctgccgtgtaaccagctgagagactctaaatccagtgacaagtct

SEQ ID NO: 10851 - DNA, 81 bp, Artificial Sequence
  source: /note="Description of Artificial Sequence: Synthetic oligonucleotide"
gatcctcttgtcccacagatatccagaaccctgaccctgccgtgttaccagctgagagactctaaatccagtgacaagtct

SEQ ID NO: 10852 - DNA, 69 bp, Artificial Sequence
  source: /note="Description of Artificial Sequence: Synthetic oligonucleotide"
gatcctcttgtcccacagatatccagaaccctgacccagctgagagactctaaatccagtgacaagtct

SEQ ID NO: 10853 - DNA, 36 bp, Artificial Sequence
  source: /note="Description of Artificial Sequence: Synthetic oligonucleotide"
gatcctcttgtcccacagatatccagtgacaagtct

SEQ ID NO: 10854 - DNA, 69 bp, Artificial Sequence
  source: /note="Description of Artificial Sequence: Synthetic oligonucleotide"
gatcctcttgtcccacagatatccagaaccctgaccctgctgagagactctaaatccagtgacaagtct

SEQ ID NO: 10855 - DNA, 75 bp, Artificial Sequence
  source: /note="Description of Artificial Sequence: Synthetic oligonucleotide"
aacaacagcattattccagaagacaccttcttccccagcccagggcagctttggtgccttcgcaggctgtttcct

SEQ ID NO: 10856 - DNA, 65 bp, Artificial Sequence
  source: /note="Description of Artificial Sequence: Synthetic oligonucleotide"
aacaacagcattattccagaagacaccttcttccccagctttggtgccttcgcaggctgtttcct

SEQ ID NO: 10857 - DNA, 79 bp, Artificial Sequence
  source: /note="Description of Artificial Sequence: Synthetic oligonucleotide"
aacaacagcattattccagaagacaccttcttccccagcccaggtagggcagctttggtgccttcgcaggctgtttcct

SEQ ID NO: 10858 - DNA, 70 bp, Artificial Sequence
  source: /note="Description of Artificial Sequence: Synthetic oligonucleotide"
aacaacagcattattccagaagacaccttcttccccagcccagctttggtgccttcgcaggctgtttcct

SEQ ID NO: 10859 - DNA, 65 bp, Artificial Sequence
  source: /note="Description of Artificial Sequence: Synthetic oligonucleotide"
aacaacagcattattccagaagacaccttcttccccagcccaggtgccttcgcaggctgtttcct

SEQ ID NO: 10860 - DNA, 81 bp, Artificial Sequence
  source: /note="Description of Artificial Sequence: Synthetic oligonucleotide"
tgtttttccttttagaaagttcctgtgatgtcaaagctggtcgagaaaagctttgaaacaggtaagacaggggtctagcct

SEQ ID NO: 10861 - DNA, 79 bp, Artificial Sequence
  source: /note="Description of Artificial Sequence: Synthetic oligonucleotide"
tgtttttccttttagaaagttcctgtgatgtcagctggtcgagaaaagctttgaaacaggtaagacaggggtctagcct

SEQ ID NO: 10862 - DNA, 67 bp, Artificial Sequence
  source: /note="Description of Artificial Sequence: Synthetic oligonucleotide"
tgtttttccttttagaaagttcctggtcgagaaaagctttgaaacaggtaagacaggggtctagcct

SEQ ID NO: 10863 - DNA, 71 bp, Artificial Sequence
  source: /note="Description of Artificial Sequence: Synthetic oligonucleotide"
tgtttttccttttagaaagttcctgtgatgtcgagaaaagctttgaaacaggtaagacaggggtctagcct

SEQ ID NO: 10864 - DNA, 45 bp, Artificial Sequence
  source: /note="Description of Artificial Sequence: Synthetic oligonucleotide"
tgtttttccttttagaaagaaacaggtaagacaggggtctagcct

SEQ ID NO: 10865 - DNA, 81 bp, Artificial Sequence
  source: /note="Description of Artificial Sequence: Synthetic oligonucleotide"
gcctcttggttttacagatacgaacctaaactttcaaaacctgtcaagtgattgggttccgaatcctcctcctgaaagtgg

SEQ ID NO: 10866 - DNA, 79 bp, Artificial Sequence
  source: /note="Description of Artificial Sequence: Synthetic oligonucleotide"
gcctcttggttttacagatacgaacctaaactttcaaaacctgtcatgattgggttccgaatcctcctcctgaaagtgg

SEQ ID NO: 10867 - DNA, 79 bp, Artificial Sequence
  source: /note="Description of Artificial Sequence: Synthetic oligonucleotide"
gcctcttggttttacagatacgaacctaaactttcaaaacctgtcgtgattgggttccgaatcctcctcctgaaagtgg

SEQ ID NO: 10868 - DNA, 76 bp, Artificial Sequence
  source: /note="Description of Artificial Sequence: Synthetic oligonucleotide"
gcctcttggttttacagatacgaacctaaactttcaaaacctgtcattgggttccgaatcctcctcctgaaagtgg

SEQ ID NO: 10869 - DNA, 78 bp, Artificial Sequence
  source: /note="Description of Artificial Sequence: Synthetic oligonucleotide"
gcctcttggttttacagatacgaacctaaactttcaaaacctgtcagattgggttccgaatcctcctcctgaaagtgg

SEQ ID NO: 10870 - DNA, 81 bp, Artificial Sequence
  source: /note="Description of Artificial Sequence: Synthetic oligonucleotide"
tgtcagtgattgggttccgaatcctcctcctgaaagtggccgggttttaatctgctcatgacgctgcggctgtggtccagc

SEQ ID NO: 10871 - DNA, 79 bp, Artificial Sequence
  source: /note="Description of Artificial Sequence: Synthetic oligonucleotide"
tgtcagtgattgggttccgaatcctcctcctgaaagtggccgggttaatctgctcatgacgctgcggctgtggtccagc

SEQ ID NO: 10872 - DNA, 80 bp, Artificial Sequence
  source: /note="Description of Artificial Sequence: Synthetic oligonucleotide"
tgtcagtgattgggttccgaatccgcctcctgaaagtggccgggtttaatctgctcatgacgctgcggctgtggtccagc

SEQ ID NO: 10873 - DNA, 80 bp, Artificial Sequence
  source: /note="Description of Artificial Sequence: Synthetic oligonucleotide"
tgtcagtgattgggttccgaatcctccgcctgaaagtggccgggtttaatctgctcatgacgctgcggctgtggtccagc

SEQ ID NO: 10874 - DNA, 66 bp, Artificial Sequence
  source: /note="Description of Artificial Sequence: Synthetic oligonucleotide"
tgtcagtgattgggttccgaatcctcctcctgaaagtggctcatgacgctgcggctgtggtccagc

SEQ ID NO: 10875 - DNA, 81 bp, Artificial Sequence; identical to SEQ ID NO: 10850
  source: /note="Description of Artificial Sequence: Synthetic oligonucleotide"

SEQ ID NO: 10876 - DNA, 81 bp, Artificial Sequence; identical to SEQ ID NO: 10851
  source: /note="Description of Artificial Sequence: Synthetic oligonucleotide"

SEQ ID NO: 10877 - DNA, 69 bp, Artificial Sequence; identical to SEQ ID NO: 10852
  source: /note="Description of Artificial Sequence: Synthetic oligonucleotide"

SEQ ID NO: 10878 - DNA, 73 bp, Artificial Sequence
  source: /note="Description of Artificial Sequence: Synthetic oligonucleotide"
gatcctcttgtcccacagatatccagaaccctgaccctgccagctgagagactctaaatccagtgacaagtct

SEQ ID NO: 10879 - DNA, 81 bp, Artificial Sequence
  source: /note="Description of Artificial Sequence: Synthetic oligonucleotide"
gatcctcttgtcccacagatatccagaaccctgaccctgccgtgtgaccagctgagagactctaaatccagtgacaagtct

SEQ ID NO: 10880 - DNA, 75 bp, Artificial Sequence; identical to SEQ ID NO: 10855
  source: /note="Description of Artificial Sequence: Synthetic oligonucleotide"

SEQ ID NO: 10881 - DNA, 65 bp, Artificial Sequence; identical to SEQ ID NO: 10856
  source: /note="Description of Artificial Sequence: Synthetic oligonucleotide"

SEQ ID NO: 10882 - DNA, 70 bp, Artificial Sequence; identical to SEQ ID NO: 10858
  source: /note="Description of Artificial Sequence: Synthetic oligonucleotide"

SEQ ID NO: 10883 - DNA, 79 bp, Artificial Sequence; identical to SEQ ID NO: 10857
  source: /note="Description of Artificial Sequence: Synthetic oligonucleotide"

SEQ ID NO: 10884 - DNA, 65 bp, Artificial Sequence; identical to SEQ ID NO: 10859
  source: /note="Description of Artificial Sequence: Synthetic oligonucleotide"

SEQ ID NO: 10885 - DNA, 79 bp, Artificial Sequence
  source: /note="Description of Artificial Sequence: Synthetic oligonucleotide"
ctttcaaaacctgtcagtgattgggttccgaatcctcctcctgaagtggccgggtttaatctgctcatgacgctgcggc

SEQ ID NO: 10886 - DNA, 79 bp, Artificial Sequence
  source: /note="Description of Artificial Sequence: Synthetic oligonucleotide"
ctttcaaaacctgtcagtgattgggttccgaatcctcctcctgaaatggccgggtttaatctgctcatgacgctgcggc

SEQ ID NO: 10887 - DNA, 82 bp, Artificial Sequence
  source: /note="Description of Artificial Sequence: Synthetic oligonucleotide"
ctttcaaaacctgtcagtgattgggttccgaatcctcctcctgaaaaagtggccgggtttaatctgctcatgacgctgcggc

SEQ ID NO: 10888 - DNA, 78 bp, Artificial Sequence
  source: /note="Description of Artificial Sequence: Synthetic oligonucleotide"
ctttcaaaacctgtcagtgattgggttccgaatcctcctcctgaatggccgggtttaatctgctcatgacgctgcggc

SEQ ID NO: 10889 - DNA, 81 bp, Artificial Sequence
  source: /note="Description of Artificial Sequence: Synthetic oligonucleotide"
ctttcaaaacctgtcagtgattgggttccgaatcctcctcctgaaaagtggccgggtttaatctgctcatgacgctgcggc

SEQ ID NO: 10890 - DNA, 79 bp, Artificial Sequence; identical to SEQ ID NO: 10871
  source: /note="Description of Artificial Sequence: Synthetic oligonucleotide"

SEQ ID NO: 10891 - DNA, 81 bp, Artificial Sequence; identical to SEQ ID NO: 10870
  source: /note="Description of Artificial Sequence: Synthetic oligonucleotide"

SEQ ID NO: 10892 - DNA, 78 bp, Artificial Sequence
  source: /note="Description of Artificial Sequence: Synthetic oligonucleotide"
tgtcagtgattgggttccgaatcctcctcctgaaagtggccgggtaatctgctcatgacgctgcggctgtggtccagc

SEQ ID NO: 10893 - DNA, 66 bp, Artificial Sequence; identical to SEQ ID NO: 10874
  source: /note="Description of Artificial Sequence: Synthetic oligonucleotide"

SEQ ID NO: 10894 - DNA, 65 bp, Artificial Sequence
  source: /note="Description of Artificial Sequence: Synthetic oligonucleotide"
tgtcagtgattgggttccgaatcctcctcctgaaagtgctcatgacgctgcggctgtggtccagc

SEQ ID NO: 10895 - DNA, 68 bp, Artificial Sequence
  source: /note="Description of Artificial Sequence: Synthetic oligonucleotide"
ctcctgaaagtggccgggtttaatctgcggctgtggtccagctgaggtgaggggccttgaagctggga

SEQ ID NO: 10896 - DNA, 81 bp, Artificial Sequence
  source: /note="Description of Artificial Sequence: Synthetic oligonucleotide"
ctcctgaaagtggccgggtttaatctgctcatgacggctgcggctgtggtccagctgaggtgaggggccttgaagctggga

SEQ ID NO: 10897 - DNA, 78 bp, Artificial Sequence
  source: /note="Description of Artificial Sequence: Synthetic oligonucleotide"
ctcctgaaagtggccgggtttaatctgctcatgactgcggctgtggtccagctgaggtgaggggccttgaagctggga

SEQ ID NO: 10898 - DNA, 79 bp, Artificial Sequence
  source: /note="Description of Artificial Sequence: Synthetic oligonucleotide"
ctcctgaaagtggccgggtttaatctgctcatgacctgcggctgtggtccagctgaggtgaggggccttgaagctggga

SEQ ID NO: 10899 - DNA, 74 bp, Artificial Sequence
  source: /note="Description of Artificial Sequence: Synthetic oligonucleotide"
ctcctgaaagtggccgggtttaatctgctcatgcggctgtggtccagctgaggtgaggggccttgaagctggga

SEQ ID NO: 10900 - DNA, 57 bp, Artificial Sequence
  source: /note="Description of Artificial Sequence: Synthetic oligonucleotide"
gaagctgacagcattcgggccgagatgtctcgcgctactctctctttctggcctgga

SEQ ID NO: 10901 - DNA, 81 bp, Artificial Sequence
  source: /note="Description of Artificial Sequence: Synthetic oligonucleotide"
gaagctgacagcattcgggccgagatgtctcgctccgtggccttagcctgtgctcgcgctactctctctttctggcctgga

SEQ ID NO: 10902 - DNA, 63 bp, Artificial Sequence
  source: /note="Description of Artificial Sequence: Synthetic oligonucleotide"
gaagctgacagcattcgggccgagatgtctcgctccgtggctactctctctttctggcctgga

SEQ ID NO: 10903 - DNA, 55 bp, Artificial Sequence
  source: /note="Description of Artificial Sequence: Synthetic oligonucleotide"
gaagctgacagcattcgggccgagatgtctcgctactctctctttctggcctgga

SEQ ID NO: 10904 - DNA, 77 bp, Artificial Sequence
  source: /note="Description of Artificial Sequence: Synthetic oligonucleotide"
gaagctgacagcattcgggccgagatgtctcgctccgtggccttagtgctcgcgctactctctctttctggcctgga

SEQ ID NO: 10905 - DNA, 69 bp, Artificial Sequence
  source: /note="Description of Artificial Sequence: Synthetic oligonucleotide"
gaagctgacagcattcgggccgagatgtctcgctccgtggctcgcgctactctctctttctggcctgga

SEQ ID NO: 10906 - DNA, 61 bp, Artificial Sequence
  source: /note="Description of Artificial Sequence: Synthetic oligonucleotide"
gaagctgacagcattcgggccgagatgtctcgctcgcgctactctctctttctggcctgga

SEQ ID NO: 10907 - DNA, 82 bp, Artificial Sequence
  source: /note="Description of Artificial Sequence: Synthetic oligonucleotide"
gaagctgacagcattcgggccgagatgtctcgctccgtggccttagctctgtgctcgcgctactctctctttctggcctgga

SEQ ID NO: 10908 - DNA, 65 bp, Artificial Sequence
  source: /note="Description of Artificial Sequence: Synthetic oligonucleotide"
gaagctgacagcattcgggccgagatgtctcgctccgtggcgctactctctctttctggcctgga

SEQ ID NO: 10909 - DNA, 75 bp, Artificial Sequence
  source: /note="Description of Artificial Sequence: Synthetic oligonucleotide"
gaagctgacagcattcgggccgagatgtctcgctccgtggccttagctcgcgctactctctctttctggcctgga

SEQ ID NO: 10910 - DNA, 76 bp, Artificial Sequence
  source: /note="Description of Artificial Sequence: Synthetic oligonucleotide"
ccgtgtgaaccatgtgactttgtcacagcccaagttaagtggggtaagtcttacattcttttgtaagctgctgaaa

SEQ ID NO: 10911 - DNA, 81 bp, Artificial Sequence
  source: /note="Description of Artificial Sequence: Synthetic oligonucleotide"
ccgtgtgaaccatgtgactttgtcacagcccaagaatagttaagtggggtaagtcttacattcttttgtaagctgctgaaa

SEQ ID NO: 10912 - DNA, 64 bp, Artificial Sequence
  source: /note="Description of Artificial Sequence: Synthetic oligonucleotide"
ccgtgtgaaccatgtgactttgttaagtggggtaagtcttacattcttttgtaagctgctgaaa

SEQ ID NO: 10913 - DNA, 71 bp, Artificial Sequence
  source: /note="Description of Artificial Sequence: Synthetic oligonucleotide"
ccgtgtgaaccatgtgactttgtcacagcccaagtggggtaagtcttacattcttttgtaagctgctgaaa

SEQ ID NO: 10914 - DNA, 50 bp, Artificial Sequence
  source: /note="Description of Artificial Sequence: Synthetic oligonucleotide"
ccgtgtgaaccatgtgactttgtcttacattcttttgtaagctgctgaaa

SEQ ID NO: 10915 - DNA, 59 bp, Artificial Sequence
  source: /note="Description of Artificial Sequence: Synthetic oligonucleotide"
ccgtgtgaaccatgtgactttgtggggtaagtcttacattcttttgtaagctgctgaaa

SEQ ID NO: 10916 - DNA, 44 bp, Artificial Sequence
  source: /note="Description of Artificial Sequence: Synthetic oligonucleotide"
ccgtgtgaaccatgtgacttacattcttttgtaagctgctgaaa

SEQ ID NO: 10917 - DNA, 79 bp, Artificial Sequence
  source: /note="Description of Artificial Sequence: Synthetic oligonucleotide"
ccgtgtgaaccatgtgactttgtcacagcccaagtagttaagtggggtaagtcttacattcttttgtaagctgctgaaa

SEQ ID NO: 10918 - DNA, 51 bp, Artificial Sequence
  source: /note="Description of Artificial Sequence: Synthetic oligonucleotide"
ccgtgtgaaccatgtggggtaagtcttacattcttttgtaagctgctgaaa

SEQ ID NO: 10919 - DNA, 78 bp, Artificial Sequence
  source: /note="Description of Artificial Sequence: Synthetic oligonucleotide"
ccgtgtgaaccatgtgactttgtcacagcccaagagttaagtggggtaagtcttacattcttttgtaagctgctgaaa

SEQ ID NO: 10920 - DNA, 81 bp, Artificial Sequence
  source: /note="Description of Artificial Sequence: Synthetic oligonucleotide"
agctcacagtgtgccaccatggagttggggccccttagaaggtggctacctggagcttcttaacagcgatgctgaccccct

SEQ ID NO: 10921 - DNA, 64 bp, Artificial Sequence
  source: /note="Description of Artificial Sequence: Synthetic oligonucleotide"
agctcacagtgtgccaccatggagttggctacctggagcttcttaacagcgatgctgaccccct

SEQ ID NO: 10922 - DNA, 66 bp, Artificial Sequence
  source: /note="Description of Artificial Sequence: Synthetic oligonucleotide"
agctcacagtgtgccaccatggagttggggctacctggagcttcttaacagcgatgctgaccccct

SEQ ID NO: 10923 - DNA, 76 bp, Artificial Sequence
  source: /note="Description of Artificial Sequence: Synthetic oligonucleotide"
agctcacagtgtgccaccatggagttggggtagaaggtggctacctggagcttcttaacagcgatgctgaccccct

SEQ ID NO: 10924 - DNA, 50 bp, Artificial Sequence
  source: /note="Description of Artificial Sequence: Synthetic oligonucleotide"
agctcacagtgtgccaccatggagcttcttaacagcgatgctgaccccct

SEQ ID NO: 10925 - DNA, 81 bp, Artificial Sequence
  source: /note="Description of Artificial Sequence: Synthetic oligonucleotide"
aactgcgaccagttcagcaggctgttgtgtgacattggaaggtgatgaagagaccagggaggcttatgccaatatcggtga

SEQ ID NO: 10926 - DNA, 68 bp, Artificial Sequence
  source: /note="Description of Artificial Sequence: Synthetic oligonucleotide"
aactgcgaccagttcagcaggctgttgtgtgatgaagagaccagggaggcttatgccaatatcggtga

SEQ ID NO: 10927 - DNA, 79 bp, Artificial Sequence
  source: /note="Description of Artificial Sequence: Synthetic oligonucleotide"
aactgcgaccagttcagcaggctgttgtgtgactggaaggtgatgaagagaccagggaggcttatgccaatatcggtga

SEQ ID NO: 10928 - DNA, 79 bp, Artificial Sequence
  source: /note="Description of Artificial Sequence: Synthetic oligonucleotide"
aactgcgaccagttcagcaggctgttgtgtgacaggaaggtgatgaagagaccagggaggcttatgccaatatcggtga

SEQ ID NO: 10929 - DNA, 78 bp, Artificial Sequence
  source: /note="Description of Artificial Sequence: Synthetic oligonucleotide"
aactgcgaccagttcagcaggctgttgtgtgatggaaggtgatgaagagaccagggaggcttatgccaatatcggtga

SEQ ID NO: 10930 - DNA, 79 bp, Artificial Sequence
  source: /note="Description of Artificial Sequence: Synthetic oligonucleotide"
caggctgttgtgtgacatggaaggtgatgaagagccagggaggcttatgccaatatcggtgaggaagcacctgagccca

SEQ ID NO: 10931 - DNA, 81 bp, Artificial Sequence
  source: /note="Description of Artificial Sequence: Synthetic oligonucleotide"
caggctgttgtgtgacatggaaggtgatgaagagaaccagggaggcttatgccaatatcggtgaggaagcacctgagccca

SEQ ID NO: 10932 - DNA, 60 bp, Artificial Sequence
  source: /note="Description of Artificial Sequence: Synthetic oligonucleotide"
caggctgttgtgtgacatggaaggcttatgccaatatcggtgaggaagcacctgagccca

SEQ ID NO: 10933 - DNA, 59 bp, Artificial Sequence
  source: /note="Description of Artificial Sequence: Synthetic oligonucleotide"
caggctgttgtgtgacagggaggcttatgccaatatcggtgaggaagcacctgagccca

SEQ ID NO: 10934 - DNA, 44 bp, Artificial Sequence
  source: /note="Description of Artificial Sequence: Synthetic oligonucleotide"
caggctgttgtgtgacatggaaggtgaggaggcacctgagccca

SEQ ID NO: 10935 - DNA, 81 bp, Artificial Sequence
  source: /note="Description of Artificial Sequence: Synthetic oligonucleotide"
tttctcaaagtagagcacataggaccagatgaagttgatcggtgagagtatggagatgccagcagaagttgggcagaaaag

SEQ ID NO: 10936 - DNA, 68 bp, Artificial Sequence
  source: /note="Description of Artificial Sequence: Synthetic oligonucleotide"
tttctcaaagtagagcacataggaccagatgagagtatggagatgccagcagaagttgggcagaaaag

SEQ ID NO: 10937 - DNA, 72 bp, Artificial Sequence
  source: /note="Description of Artificial Sequence: Synthetic oligonucleotide"
tttctcaaagtagagcacataggaccagatcggtgagagtatggagatgccagcagaagttgggcagaaaag

SEQ ID NO: 10938 - DNA, 63 bp, Artificial Sequence
  source: /note="Description of Artificial Sequence: Synthetic oligonucleotide"
tttctcaaagtagagcacataggaccagagtatggagatgccagcagaagttgggcagaaaag

SEQ ID NO: 10939 - DNA, 75 bp, Artificial Sequence
  source: /note="Description of Artificial Sequence: Synthetic oligonucleotide"
tttctcaaagtagagcacataggaccagatgatcggtgagagtatggagatgccagcagaagttgggcagaaaag

SEQ ID NO: 10940 - DNA, 63 bp, Artificial Sequence
  source: /note="Description of Artificial Sequence: Synthetic oligonucleotide"
tgagcattgtcttccctcccaggcagctcacagtgtgcccctagaaggtggctacctggagct

SEQ ID NO: 10941 - DNA, 81 bp, Artificial Sequence
  source: /note="Description of Artificial Sequence: Synthetic oligonucleotide"
tgagcattgtcttccctcccaggcagctcacagtgtgccaccattggagttggggcccctagaaggtggctacctggagct

SEQ ID NO: 10942 - DNA, 79 bp, Artificial Sequence
  source: /note="Description of Artificial Sequence: Synthetic oligonucleotide"
tgagcattgtcttccctcccaggcagctcacagtgtgccaccaggagttggggcccctagaaggtggctacctggagct

SEQ ID NO: 10943 - DNA, 78 bp, Artificial Sequence
  source: /note="Description of Artificial Sequence: Synthetic oligonucleotide"
tgagcattgtcttccctcccaggcagctcacagtgtgccaccagagttggggcccctagaaggtggctacctggagct

SEQ ID NO: 10944 - DNA, 49 bp, Artificial Sequence
  source: /note="Description of Artificial Sequence: Synthetic oligonucleotide"
tgagcattgtcttccctcccaggcccctagaaggtggctacctggagct

SEQ ID NO: 10945 - DNA, 79 bp, Artificial Sequence
  source: /note="Description of Artificial Sequence: Synthetic oligonucleotide"
gggggtcagcatcgctgttaagaagctccaggtagccacctctaggggccccaactccatggtggcacactgtgagctg

SEQ ID NO: 10946 - DNA, 78 bp, Artificial Sequence
  source: /note="Description of Artificial Sequence: Synthetic oligonucleotide"
gggggtcagcatcgctgttaagaagctccaggtagccactctaggggccccaactccatggtggcacactgtgagctg

SEQ ID NO: 10947 - DNA, 66 bp, Artificial Sequence
  source: /note="Description of Artificial Sequence: Synthetic oligonucleotide"
gggggtcagcatcgctgttaagaagctccaggtagccccaactccatggtggcacactgtgagctg

SEQ ID NO: 10948 - DNA, 81 bp, Artificial Sequence
  source: /note="Description of Artificial Sequence: Synthetic oligonucleotide"
gggggtcagcatcgctgttaagaagctccaggtagccacctttctaggggccccaactccatggtggcacactgtgagctg

SEQ ID NO: 10949 - DNA, 77 bp, Artificial Sequence
  source: /note="Description of Artificial Sequence: Synthetic oligonucleotide"
gggggtcagcatcgctgttaagaagctccaggtagccatctaggggccccaactccatggtggcacactgtgagctg

SEQ ID NO: 10950 - DNA, 81 bp, Artificial Sequence
  source: /note="Description of Artificial Sequence: Synthetic oligonucleotide"
ggtggctacctggagcttcttaacagcgatgctgaccccctgtggcctctaccacttctatgaccagatggacctggctgg

SEQ ID NO: 10951 - DNA, 74 bp, Artificial Sequence
  source: /note="Description of Artificial Sequence: Synthetic oligonucleotide"
ggtggctacctggagcttcttaacagcgatgctgaccccctctaccacttctatgaccagatggacctggctgg

SEQ ID NO: 10952 - DNA, 65 bp, Artificial Sequence
  source: /note="Description of Artificial Sequence: Synthetic oligonucleotide"
ggtggctacctggagcttcttaacagcgatgctgaccacttctatgaccagatggacctggctgg

SEQ ID NO: 10953 - DNA, 79 bp, Artificial Sequence
  source: /note="Description of Artificial Sequence: Synthetic oligonucleotide"
ggtggctacctggagcttcttaacagcgatgctgaccccctgtgctctaccacttctatgaccagatggacctggctgg

SEQ ID NO: 10954 - DNA, 77 bp, Artificial Sequence
  source: /note="Description of Artificial Sequence: Synthetic oligonucleotide"
ggtggctacctggagcttcttaacagcgatgctgaccccctgtgctaccacttctatgaccagatggacctggctgg

SEQ ID NO: 10955 - DNA, 68 bp, Artificial Sequence
  source: /note="Description of Artificial Sequence: Synthetic oligonucleotide"
agcttcttaacagcgatgctgaccccctgtgcctctaccagatggacctggctggagaagaagagatt

SEQ ID NO: 10956 - DNA, 77 bp, Artificial Sequence
  source: /note="Description of Artificial Sequence: Synthetic oligonucleotide"
agcttcttaacagcgatgctgaccccctgtgcctctaccactatgaccagatggacctggctggagaagaagagatt

SEQ ID NO: 10957 - DNA, 62 bp, Artificial Sequence
  source: /note="Description of Artificial Sequence: Synthetic oligonucleotide"
agcttcttaacagcgatgctgaccccctgtgccagatggacctggctggagaagaagagatt

SEQ ID NO: 10958 - DNA, 78 bp, Artificial Sequence
  source: /note="Description of Artificial Sequence: Synthetic oligonucleotide"
agcttcttaacagcgatgctgaccccctgtgcctctaccacttatgaccagatggacctggctggagaagaagagatt

SEQ ID NO: 10959 - DNA, 79 bp, Artificial Sequence
  source: /note="Description of Artificial Sequence: Synthetic oligonucleotide"
agcttcttaacagcgatgctgaccccctgtgcctctaccactttatgaccagatggacctggctggagaagaagagatt

SEQ ID NO: 10960 - DNA, 81 bp, Artificial Sequence
  source: /note="Description of Artificial Sequence: Synthetic oligonucleotide"
tttttctcaaagtagagcacataggaccagatgaagttgatcggtgagagtatggagatgccagcagaagttgggcagaaa

SEQ ID NO: 10961 - DNA, 68 bp, Artificial Sequence
  source: /note="Description of Artificial Sequence: Synthetic oligonucleotide"
tttttctcaaagtagagcacataggaccagatgagagtatggagatgccagcagaagttgggcagaaa

SEQ ID NO: 10962 - DNA, 72 bp, Artificial Sequence
  source: /note="Description of Artificial Sequence: Synthetic oligonucleotide"
tttttctcaaagtagagcacataggaccagatcggtgagagtatggagatgccagcagaagttgggcagaaa

SEQ ID NO: 10963 - DNA, 78 bp, Artificial Sequence
  source: /note="Description of Artificial Sequence: Synthetic oligonucleotide"
tttttctcaaagtagagcacataggaccagatgatgatcggtgagagtatggagatgccagcagaagttgggcagaaa

SEQ ID NO: 10964 - DNA, 77 bp, Artificial Sequence
  source: /note="Description of Artificial Sequence: Synthetic oligonucleotide"
tttttctcaaagtagagcacataggaccagatgtgatcggtgagagtatggagatgccagcagaagttgggcagaaa

SEQ ID NO: 10965 - DNA, 77 bp, Artificial Sequence
  source: /note="Description of Artificial Sequence: Synthetic oligonucleotide"
gcattgtcttccctcccaggcagctcacagtgtgccatggagttggggcccctagaaggtggctacctggagcttct

SEQ ID NO: 10966 - DNA, 81 bp, Artificial Sequence
  source: /note="Description of Artificial Sequence: Synthetic oligonucleotide"
gcattgtcttccctcccaggcagctcacagtgtgccaaccatggagttggggcccctagaaggtggctacctggagcttct

SEQ ID NO: 10967 - DNA, 78 bp, Artificial Sequence
  source: /note="Description of Artificial Sequence: Synthetic oligonucleotide"
gcattgtcttccctcccaggcagctcacagtgtgccaatggagttggggcccctagaaggtggctacctggagcttct

SEQ ID NO: 10968 - DNA, 79 bp, Artificial Sequence
  source: /note="Description of Artificial Sequence: Synthetic oligonucleotide"
gcattgtcttccctcccaggcagctcacagtgtgccccatggagttggggcccctagaaggtggctacctggagcttct

SEQ ID NO: 10969 - DNA, 79 bp, Artificial Sequence
  source: /note="Description of Artificial Sequence: Synthetic oligonucleotide"
gcattgtcttccctcccaggcagctcacagtgtgccacatggagttggggcccctagaaggtggctacctggagcttct

SEQ ID NO: 10970 - DNA, 81 bp, Artificial Sequence
  source: /note="Description of Artificial Sequence: Synthetic oligonucleotide"
gcagctcacagtgtgccaccatggagttggggccccttagaaggtggctacctggagcttcttaacagcgatgctgacccc

SEQ ID NO: 10971 - DNA, 79 bp, Artificial Sequence
  source: /note="Description of Artificial Sequence: Synthetic oligonucleotide"
gcagctcacagtgtgccaccatggagttggggccccagaaggtggctacctggagcttcttaacagcgatgctgacccc

SEQ ID NO: 10972 - DNA, 76 bp, Artificial Sequence
  source: /note="Description of Artificial Sequence: Synthetic oligonucleotide"
gcagctcacagtgtgccaccatggagttggggtagaaggtggctacctggagcttcttaacagcgatgctgacccc

SEQ ID NO: 10973 - DNA, 50 bp, Artificial Sequence
  source: /note="Description of Artificial Sequence: Synthetic oligonucleotide"
gcagctcacagtgtgccaccatggagcttcttaacagcgatgctgacccc

SEQ ID NO: 10974 - DNA, 64 bp, Artificial Sequence
  source: /note="Description of Artificial Sequence: Synthetic oligonucleotide"
gcagctcacagtgtgccaccatggagttggctacctggagcttcttaacagcgatgctgacccc

SEQ ID NO: 10975 - DNA, 81 bp, Artificial Sequence; identical to SEQ ID NO: 10970
  source: /note="Description of Artificial Sequence: Synthetic oligonucleotide"

SEQ ID NO: 10976 - DNA, 76 bp, Artificial Sequence; identical to SEQ ID NO: 10972
  source: /note="Description of Artificial Sequence: Synthetic oligonucleotide"

SEQ ID NO: 10977 - DNA, 79 bp, Artificial Sequence; identical to SEQ ID NO: 10971
  source: /note="Description of Artificial Sequence: Synthetic oligonucleotide"

SEQ ID NO: 10978 - DNA, 50 bp, Artificial Sequence; identical to SEQ ID NO: 10973
  source: /note="Description of Artificial Sequence: Synthetic oligonucleotide"

SEQ ID NO: 10979 - DNA, 66 bp, Artificial Sequence
  source: /note="Description of Artificial Sequence: Synthetic oligonucleotide"
gcagctcacagtgtgccaccatggagttggggctacctggagcttcttaacagcgatgctgacccc

SEQ ID NO: 10980 - DNA, 75 bp, Artificial Sequence
  source: /note="Description of Artificial Sequence: Synthetic oligonucleotide"
gcagctcacagtgtgccaccatggagttgggtagaaggtggctacctggagcttcttaacagcgatgctgacccc

SEQ ID NO: 10981 - DNA, 64 bp, Artificial Sequence; identical to SEQ ID NO: 10974
  source: /note="Description of Artificial Sequence: Synthetic oligonucleotide"

SEQ ID NO: 10982 - DNA, 49 bp, Artificial Sequence
  source: /note="Description of Artificial Sequence: Synthetic oligonucleotide"
gcagctcacagtgtgccacctggagcttcttaacagcgatgctgacccc

SEQ ID NO: 10983 - DNA, 79 bp, Artificial Sequence
  source: /note="Description of Artificial Sequence: Synthetic oligonucleotide"
gcagctcacagtgtgccaccatggagttggggccctagaaggtggctacctggagcttcttaacagcgatgctgacccc

SEQ ID NO: 10984 - DNA, 75 bp, Artificial Sequence
  source: /note="Description of Artificial Sequence: Synthetic oligonucleotide"
gcagctcacagtgtgccaccatggagttggggagaaggtggctacctggagcttcttaacagcgatgctgacccc

SEQ ID NO: 10985 - DNA, 78 bp, Artificial Sequence
  source: /note="Description of Artificial Sequence: Synthetic oligonucleotide"
cagcaggctgttgtgtgacatggaaggtgatgaagaccagggaggcttatgccaatatcggtgaggaagcacctgagc

SEQ ID NO: 10986 - DNA, 79 bp, Artificial Sequence
  source: /note="Description of Artificial Sequence: Synthetic oligonucleotide"
cagcaggctgttgtgtgacatggaaggtgatgaagaaccagggaggcttatgccaatatcggtgaggaagcacctgagc

SEQ ID NO: 10987 - DNA, 64 bp, Artificial Sequence
  source: /note="Description of Artificial Sequence: Synthetic oligonucleotide"
cagcaggctgttgtgtgacatggaagggaggcttatgccaatatcggtgaggaagcacctgagc

SEQ ID NO: 10988 - DNA, 71 bp, Artificial Sequence
  source: /note="Description of Artificial Sequence: Synthetic oligonucleotide"
cagcaggctgttgtgtgacatggaaggtgatgaagaggcttatgccaatatcggtgaggaagcacctgagc

SEQ ID NO: 10989 - DNA, 60 bp, Artificial Sequence
  source: /note="Description of Artificial Sequence: Synthetic oligonucleotide"
cagcaggctgttgtgtgacatggaaggcttatgccaatatcggtgaggaagcacctgagc

SEQ ID NO: 10990 - DNA, 78 bp, Artificial Sequence
  source: /note="Description of Artificial Sequence: Synthetic oligonucleotide"
cagcaggctgttgtgtgacatggaaggtgatgaagagcagggaggcttatgccaatatcggtgaggaagcacctgagc

SEQ ID NO: 10991 - DNA, 73 bp, Artificial Sequence
  source: /note="Description of Artificial Sequence: Synthetic oligonucleotide"
cagcaggctgttgtgtgacatggaaggtgatgaagggaggcttatgccaatatcggtgaggaagcacctgagc

SEQ ID NO: 10992 - DNA, 59 bp, Artificial Sequence
  source: /note="Description of Artificial Sequence: Synthetic oligonucleotide"
cagcaggctgttgtgtgacagggaggcttatgccaatatcggtgaggaagcacctgagc

SEQ ID NO: 10993 - DNA, 44 bp, Artificial Sequence
  source: /note="Description of Artificial Sequence: Synthetic oligonucleotide"
cagcaggctgttgtgtgacatggaaggtgaggaagcacctgagc

SEQ ID NO: 10994 - DNA, 76 bp, Artificial Sequence
  source: /note="Description of Artificial Sequence: Synthetic oligonucleotide"
cagcaggctgttgtgtgacatggaaggtgatgaaccagggaggcttatgccaatatcggtgaggaagcacctgagc

SEQ ID NO: 10995 - DNA, 79 bp, Artificial Sequence
  source: /note="Description of Artificial Sequence: Synthetic oligonucleotide"
agcaggctgttgtgtgacatggaaggtgatgaagagccagggaggcttatgccaatatcggtgaggaagcacctgagcc

SEQ ID NO: 10996 - DNA, 81 bp, Artificial Sequence
  source: /note="Description of Artificial Sequence: Synthetic oligonucleotide"
agcaggctgttgtgtgacatggaaggtgatgaagagaaccagggaggcttatgccaatatcggtgaggaagcacctgagcc

SEQ ID NO: 10997 - DNA, 44 bp, Artificial Sequence
  source: /note="Description of Artificial Sequence: Synthetic oligonucleotide"
agcaggctgttgtgtgacatggaaggtgaggaagcacctgagcc

SEQ ID NO: 10998 - DNA, 60 bp, Artificial Sequence
  source: /note="Description of Artificial Sequence: Synthetic oligonucleotide"
agcaggctgttgtgtgacatggaaggcttatgccaatatcggtgaggaagcacctgagcc

SEQ ID NO: 10999 - DNA, 59 bp, Artificial Sequence
  source: /note="Description of Artificial Sequence: Synthetic oligonucleotide"
agcaggctgttgtgtgacatggaaggtgatgccaatatcggtgaggaagcacctgagcc

SEQ ID NO: 11000 - DNA, 71 bp, Artificial Sequence
  source: /note="Description of Artificial Sequence: Synthetic oligonucleotide"
agcaggctgttgtgtgacatggaaggtgatgaagaggcttatgccaatatcggtgaggaagcacctgagcc

SEQ ID NO: 11001 - DNA, 64 bp, Artificial Sequence
  source: /note="Description of Artificial Sequence: Synthetic oligonucleotide"
agcaggctgttgtgtgacatggaagggaggcttatgccaatatcggtgaggaagcacctgagcc

SEQ ID NO: 11002 - DNA, 78 bp, Artificial Sequence
  source: /note="Description of Artificial Sequence: Synthetic oligonucleotide"
agcaggctgttgtgtgacatggaaggtgatgaagaccagggaggcttatgccaatatcggtgaggaagcacctgagcc

SEQ ID NO: 11003 - DNA, 73 bp, Artificial Sequence
  source: /note="Description of Artificial Sequence: Synthetic oligonucleotide"
agcaggctgttgtgtgacatggaaggtgatgaagggaggcttatgccaatatcggtgaggaagcacctgagcc

SEQ ID NO: 11004 - DNA, 79 bp, Artificial Sequence
  source: /note="Description of Artificial Sequence: Synthetic oligonucleotide"
agcaggctgttgtgtgacatggaaggtgatgaagagacagggaggcttatgccaatatcggtgaggaagcacctgagcc

SEQ ID NO: 11005 - DNA, 81 bp, Artificial Sequence; identical to SEQ ID NO: 10960
  source: /note="Description of Artificial Sequence: Synthetic oligonucleotide"

SEQ ID NO: 11006 - DNA, 72 bp, Artificial Sequence; identical to SEQ ID NO: 10962
  source: /note="Description of Artificial Sequence: Synthetic oligonucleotide"

SEQ ID NO: 11007 - DNA, 78 bp, Artificial Sequence; identical to SEQ ID NO: 10963
  source: /note="Description of Artificial Sequence: Synthetic oligonucleotide"

SEQ ID NO: 11008 - DNA, 75 bp, Artificial Sequence
  source: /note="Description of Artificial Sequence: Synthetic oligonucleotide"
tttttctcaaagtagagcacataggaccagatgatcggtgagagtatggagatgccagcagaagttgggcagaaa

SEQ ID NO: 11009 - DNA, 68 bp, Artificial Sequence; identical to SEQ ID NO: 10961
  source: /note="Description of Artificial Sequence: Synthetic oligonucleotide"

SEQ ID NO: 11010 - DNA, 78 bp, Artificial Sequence
  source: /note="Description of Artificial Sequence: Synthetic oligonucleotide"
tttttctcaaagtagagcacataggaccagatgaagatcggtgagagtatggagatgccagcagaagttgggcagaaa

SEQ ID NO: 11011 - DNA, 79 bp, Artificial Sequence
  source: /note="Description of Artificial Sequence: Synthetic oligonucleotide"
tttttctcaaagtagagcacataggaccagatgaatgatcggtgagagtatggagatgccagcagaagttgggcagaaa

SEQ ID NO: 11012 - DNA, 77 bp, Artificial Sequence; identical to SEQ ID NO: 10964
  source: /note="Description of Artificial Sequence: Synthetic oligonucleotide"

SEQ ID NO: 11013 - DNA, 76 bp, Artificial Sequence
  source: /note="Description of Artificial Sequence: Synthetic oligonucleotide"
tttttctcaaagtagagcacataggaccagattgatcggtgagagtatggagatgccagcagaagttgggcagaaa

SEQ ID NO: 11014 - DNA, 77 bp, Artificial Sequence
  source: /note="Description of Artificial Sequence: Synthetic oligonucleotide"
tttttctcaaagtagagcacataggaccagatgagatcggtgagagtatggagatgccagcagaagttgggcagaaa

SEQ ID NO: 11015 - DNA, 81 bp, Artificial Sequence
  source: /note="Description of Artificial Sequence: Synthetic oligonucleotide"
gtcgcgctggcgggcattcctgaagctgacagcattcgggccgagattgtctcgctccgtggccttagctgtgctcgcgct

SEQ ID NO: 11016 - DNA, 65 bp, Artificial Sequence
  source: /note="Description of Artificial Sequence: Synthetic oligonucleotide"
gtcgcgctggcgggcattcctgaagctgacagcattcgctccgtggccttagctgtgctcgcgct

SEQ ID NO: 11017 - DNA, 65 bp, Artificial Sequence
  source: /note="Description of Artificial Sequence: Synthetic oligonucleotide"
gtcgcgctggcgggcattcctgaagctgacagcattcgggccgtggccttagctgtgctcgcgct

SEQ ID NO: 11018 - DNA, 59 bp, Artificial Sequence
  source: /note="Description of Artificial Sequence: Synthetic oligonucleotide"
gtcgcgctggcgggcattcctgaagctgacagcattcgggccttagctgtgctcgcgct

SEQ ID NO: 11019 - DNA, 79 bp, Artificial Sequence
  source: /note="Description of Artificial Sequence: Synthetic oligonucleotide"
gtcgcgctggcgggcattcctgaagctgacagcattcgggccgagagtctcgctccgtggccttagctgtgctcgcgct

SEQ ID NO: 11020 - DNA, 78 bp, Artificial Sequence
  source: /note="Description of Artificial Sequence: Synthetic oligonucleotide"
gtcgcgctggcgggcattcctgaagctgacagcattcgggccgagatctcgctccgtggccttagctgtgctcgcgct

SEQ ID NO: 11021 - DNA, 59 bp, Artificial Sequence
  source: /note="Description of Artificial Sequence: Synthetic oligonucleotide"
gtcgcgctggcgggcattcctgaagctgacagctccgtggccttagctgtgctcgcgct

SEQ ID NO: 11022 - DNA, 60 bp, Artificial Sequence
  source: /note="Description of Artificial Sequence: Synthetic oligonucleotide"
gtcgcgctggcgggcattcctgaagctgacagcattcgtggccttagctgtgctcgcgct

SEQ ID NO: 11023 - DNA, 60 bp, Artificial Sequence
  source: /note="Description of Artificial Sequence: Synthetic oligonucleotide"
gtcgcgctggcgggcattcctgaagctgacagcatccgtggccttagctgtgctcgcgct

SEQ ID NO: 11024 - DNA, 81 bp, Artificial Sequence
  source: /note="Description of Artificial Sequence: Synthetic oligonucleotide"
gtcgcgctggcgggcattcctgaagctgacagcattcgggccgagaatgtctcgctccgtggccttagctgtgctcgcgct

SEQ ID NO: 11025 - DNA, 65 bp, Artificial Sequence; identical to SEQ ID NO: 11016
  source: /note="Description of Artificial Sequence: Synthetic oligonucleotide"

SEQ ID NO: 11026 - DNA, 81 bp, Artificial Sequence; identical to SEQ ID NO: 11015
  source: /note="Description of Artificial Sequence: Synthetic oligonucleotide"

SEQ ID NO: 11027 - DNA, 65 bp, Artificial Sequence; identical to SEQ ID NO: 11017
  source: /note="Description of Artificial Sequence: Synthetic oligonucleotide"

SEQ ID NO: 11028 - DNA, 59 bp, Artificial Sequence; identical to SEQ ID NO: 11018
  source: /note="Description of Artificial Sequence: Synthetic oligonucleotide"

SEQ ID NO: 11029 - DNA, 79 bp, Artificial Sequence; identical to SEQ ID NO: 11019
  source: /note="Description of Artificial Sequence: Synthetic oligonucleotide"

SEQ ID NO: 11030 - DNA, 59 bp, Artificial Sequence; identical to SEQ ID NO: 11021
  source: /note="Description of Artificial Sequence: Synthetic oligonucleotide"

SEQ ID NO: 11031 - DNA, 78 bp, Artificial Sequence; identical to SEQ ID NO: 11020
  source: /note="Description of Artificial Sequence: Synthetic oligonucleotide"

SEQ ID NO: 11032 - DNA, 81 bp, Artificial Sequence; identical to SEQ ID NO: 11024
  source: /note="Description of Artificial Sequence: Synthetic oligonucleotide"

SEQ ID NO: 11033 - DNA, 60 bp, Artificial Sequence; identical to SEQ ID NO: 11023
  source: /note="Description of Artificial Sequence: Synthetic oligonucleotide"

SEQ ID NO: 11034 - DNA, 60 bp, Artificial Sequence; identical to SEQ ID NO: 11022
  source: /note="Description of Artificial Sequence: Synthetic oligonucleotide"

SEQ ID NO: 11035 - DNA, 81 bp, Artificial Sequence; identical to SEQ ID NO: 11015
  source: /note="Description of Artificial Sequence: Synthetic oligonucleotide"

SEQ ID NO: 11036 - DNA, 65 bp, Artificial Sequence; identical to SEQ ID NO: 11016
  source: /note="Description of Artificial Sequence: Synthetic oligonucleotide"

SEQ ID NO: 11037 - DNA, 65 bp, Artificial Sequence; identical to SEQ ID NO: 11017
  source: /note="Description of Artificial Sequence: Synthetic oligonucleotide"

SEQ ID NO: 11038 - DNA, 59 bp, Artificial Sequence; identical to SEQ ID NO: 11018
  source: /note="Description of Artificial Sequence: Synthetic oligonucleotide"

SEQ ID NO: 11039 - DNA, 79 bp, Artificial Sequence; identical to SEQ ID NO: 11019
  source: /note="Description of Artificial Sequence: Synthetic oligonucleotide"

SEQ ID NO: 11040 - DNA, 78 bp, Artificial Sequence; identical to SEQ ID NO: 11020
  source: /note="Description of Artificial Sequence: Synthetic oligonucleotide"

SEQ ID NO: 11041 - DNA, 59 bp, Artificial Sequence; identical to SEQ ID NO: 11021
  source: /note="Description of Artificial Sequence: Synthetic oligonucleotide"

SEQ ID NO: 11042 - DNA, 60 bp, Artificial Sequence; identical to SEQ ID NO: 11022
  source: /note="Description of Artificial Sequence: Synthetic oligonucleotide"

SEQ ID NO: 11043 - DNA, 60 bp, Artificial Sequence; identical to SEQ ID NO: 11023
  source: /note="Description of Artificial Sequence: Synthetic oligonucleotide"

SEQ ID NO: 11044 - DNA, 67 bp, Artificial Sequence
  source: /note="Description of Artificial Sequence: Synthetic oligonucleotide"
gtcgcgctggcgggcattcctgaagctgacagcattcgggctccgtggccttagctgtgctcgcgct

SEQ ID NO: 11045 - DNA, 65 bp, Artificial Sequence; identical to SEQ ID NO: 11016
  source: /note="Description of Artificial Sequence: Synthetic oligonucleotide"

SEQ ID NO: 11046 - DNA, 81 bp, Artificial Sequence; identical to SEQ ID NO: 11015
  source: /note="Description of Artificial Sequence: Synthetic oligonucleotide"

SEQ ID NO: 11047 - DNA, 65 bp, Artificial Sequence; identical to SEQ ID NO: 11017
  source: /note="Description of Artificial Sequence: Synthetic oligonucleotide"

SEQ ID NO: 11048 - DNA, 59 bp, Artificial Sequence; identical to SEQ ID NO: 11018
  source: /note="Description of Artificial Sequence: Synthetic oligonucleotide"

SEQ ID NO: 11049 - DNA, 79 bp, Artificial Sequence; identical to SEQ ID NO: 11019
  source: /note="Description of Artificial Sequence: Synthetic oligonucleotide"

SEQ ID NO: 11050 - DNA, 59 bp, Artificial Sequence; identical to SEQ ID NO: 11021
  source: /note="Description of Artificial Sequence: Synthetic oligonucleotide"

SEQ ID NO: 11051 - DNA, 78 bp, Artificial Sequence; identical to SEQ ID NO: 11020
  source: /note="Description of Artificial Sequence: Synthetic oligonucleotide"

SEQ ID NO: 11052 - DNA, 81 bp, Artificial Sequence; identical to SEQ ID NO: 11024
  source: /note="Description of Artificial Sequence: Synthetic oligonucleotide"

SEQ ID NO: 11053 - DNA, 60 bp, Artificial Sequence; identical to SEQ ID NO: 11022
  source: /note="Description of Artificial Sequence: Synthetic oligonucleotide"

SEQ ID NO: 11054 - DNA, 67 bp, Artificial Sequence; identical to SEQ ID NO: 11044
  source: /note="Description of Artificial Sequence: Synthetic oligonucleotide"

SEQ ID NO: 11055 - DNA, 81 bp, Artificial Sequence
  source: /note="Description of Artificial Sequence: Synthetic oligonucleotide"
tgatcctcttgtcccacagatatccagaaccctgaccctgccgtgtaaccagctgagagactctaaatccagtgacaagtc

SEQ ID NO: 11056 - DNA, 81 bp, Artificial Sequence
  source: /note="Description of Artificial Sequence: Synthetic oligonucleotide"
tgatcctcttgtcccacagatatccagaaccctgaccctgccgtgttaccagctgagagactctaaatccagtgacaagtc

SEQ ID NO: 11057 - DNA, 69 bp, Artificial Sequence
  source: /note="Description of Artificial Sequence: Synthetic oligonucleotide"
tgatcctcttgtcccacagatatccagaaccctgacccagctgagagactctaaatccagtgacaagtc

SEQ ID NO: 11058 - DNA, 81 bp, Artificial Sequence
  source: /note="Description of Artificial Sequence: Synthetic oligonucleotide"
tgatcctcttgtcccacagatatccagaaccctgaccctgccgtgtgaccagctgagagactctaaatccagtgacaagtc

SEQ ID NO: 11059 - DNA, 73 bp, Artificial Sequence
  source: /note="Description of Artificial Sequence: Synthetic oligonucleotide"
tgatcctcttgtcccacagatatccagaaccctgaccctgccagctgagagactctaaatccagtgacaagtc

SEQ ID NO: 11060 - DNA, 69 bp, Artificial Sequence
  source: /note="Description of Artificial Sequence: Synthetic oligonucleotide"
tgatcctcttgtcccacagatatccagaaccctgaccctgctgagagactctaaatccagtgacaagtc

SEQ ID NO: 11061 - DNA, 56 bp, Artificial Sequence
  source: /note="Description of Artificial Sequence: Synthetic oligonucleotide"
tgatcctcttgtcccacagatatccagaaccctgactctaaatccagtgacaagtc

SEQ ID NO: 11062 - DNA, 68 bp, Artificial Sequence
  source: /note="Description of Artificial Sequence: Synthetic oligonucleotide"
tgatcctcttgtcccacagatatccagaaccctgaccagctgagagactctaaatccagtgacaagtc

SEQ ID NO: 11063 - DNA, 66 bp, Artificial Sequence
  source: /note="Description of Artificial Sequence: Synthetic oligonucleotide"
tgatcctcttgtcccacagatatccagaaccctgaccctgagagactctaaatccagtgacaagtc

SEQ ID NO: 11064 - DNA, 78 bp, Artificial Sequence
  source: /note="Description of Artificial Sequence: Synthetic oligonucleotide"
tgatcctcttgtcccacagatatccagaaccctgaccctgccgtgtcagctgagagactctaaatccagtgacaagtc

SEQ ID NO: 11065 - DNA, 81 bp, Artificial Sequence; identical to SEQ ID NO: 11055
  source: /note="Description of Artificial Sequence: Synthetic oligonucleotide"

SEQ ID NO: 11066 - DNA, 81 bp, Artificial Sequence; identical to SEQ ID NO: 11056
  source: /note="Description of Artificial Sequence: Synthetic oligonucleotide"

SEQ ID NO: 11067 - DNA, 69 bp, Artificial Sequence; identical to SEQ ID NO: 11057
  source: /note="Description of Artificial Sequence: Synthetic oligonucleotide"

SEQ ID NO: 11068 - DNA, 81 bp, Artificial Sequence; identical to SEQ ID NO: 11058
  source: /note="Description of Artificial Sequence: Synthetic oligonucleotide"

SEQ ID NO: 11069 - DNA, 73 bp, Artificial Sequence; identical to SEQ ID NO: 11059
  source: /note="Description of Artificial Sequence: Synthetic oligonucleotide"

SEQ ID NO: 11070 - DNA, 69 bp, Artificial Sequence; identical to SEQ ID NO: 11060
  source: /note="Description of Artificial Sequence: Synthetic oligonucleotide"

SEQ ID NO: 11071 - DNA, 77 bp, Artificial Sequence
  source: /note="Description of Artificial Sequence: Synthetic oligonucleotide"
tgatcctcttgtcccacagatatccagaaccctgaccctgccgtgtagctgagagactctaaatccagtgacaagtc

SEQ ID NO: 11072 - DNA, 68 bp, Artificial Sequence; identical to SEQ ID NO: 11062
  source: /note="Description of Artificial Sequence: Synthetic oligonucleotide"

SEQ ID NO: 11073 - DNA, 66 bp, Artificial Sequence; identical to SEQ ID NO: 11063
  source: /note="Description of Artificial Sequence: Synthetic oligonucleotide"

SEQ ID NO: 11074 - DNA, 82 bp, Artificial Sequence
  source: /note="Description of Artificial Sequence: Synthetic oligonucleotide"
tgatcctcttgtcccacagatatccagaaccctgaccctgccgtgtataccagctgagagactctaaatccagtgacaagtc

SEQ ID NO: 11075 - DNA, 81 bp, Artificial Sequence; identical to SEQ ID NO: 11055
  source: /note="Description of Artificial Sequence: Synthetic oligonucleotide"

SEQ ID NO: 11076 - DNA, 81 bp, Artificial Sequence; identical to SEQ ID NO: 11056
  source: /note="Description of Artificial Sequence: Synthetic oligonucleotide"

SEQ ID NO: 11077 - DNA, 69 bp, Artificial Sequence; identical to SEQ ID NO: 11057
  source: /note="Description of Artificial Sequence: Synthetic oligonucleotide"

SEQ ID NO: 11078 - DNA, 73 bp, Artificial Sequence; identical to SEQ ID NO: 11059
  source: /note="Description of Artificial Sequence: Synthetic oligonucleotide"

SEQ ID NO: 11079 - DNA, 81 bp, Artificial Sequence; identical to SEQ ID NO: 11058
  source: /note="Description of Artificial Sequence: Synthetic oligonucleotide"

SEQ ID NO: 11080 - DNA, 69 bp, Artificial Sequence; identical to SEQ ID NO: 11060
  source: /note="Description of Artificial Sequence: Synthetic oligonucleotide"

SEQ ID NO: 11081 - DNA, 68 bp, Artificial Sequence; identical to SEQ ID NO: 11062
  source: /note="Description of Artificial Sequence: Synthetic oligonucleotide"

SEQ ID NO: 11082 - DNA, 78 bp, Artificial Sequence; identical to SEQ ID NO: 11064
  source: /note="Description of Artificial Sequence: Synthetic oligonucleotide"

SEQ ID NO: 11083 - DNA, 82 bp, Artificial Sequence; identical to SEQ ID NO: 11074
  source: /note="Description of Artificial Sequence: Synthetic oligonucleotide"

SEQ ID NO: 11084 - DNA, 79 bp, Artificial Sequence
  source: /note="Description of Artificial Sequence: Synthetic oligonucleotide"
tgatcctcttgtcccacagatatccagaaccctgaccctgccgtgaccagctgagagactctaaatccagtgacaagtc

SEQ ID NO: 11085 - DNA, 81 bp, Artificial Sequence; identical to SEQ ID NO: 11055
  source: /note="Description of Artificial Sequence: Synthetic oligonucleotide"

SEQ ID NO: 11086 - DNA, 81 bp, Artificial Sequence; identical to SEQ ID NO: 11056
  source: /note="Description of Artificial Sequence: Synthetic oligonucleotide"

SEQ ID NO: 11087 - DNA, 69 bp, Artificial Sequence; identical to SEQ ID NO: 11057
  source: /note="Description of Artificial Sequence: Synthetic oligonucleotide"

SEQ ID NO: 11088 - DNA, 73 bp, Artificial Sequence; identical to SEQ ID NO: 11059
  source: /note="Description of Artificial Sequence: Synthetic oligonucleotide"

SEQ ID NO: 11089 - DNA, 69 bp, Artificial Sequence; identical to SEQ ID NO: 11060
  source: /note="Description of Artificial Sequence: Synthetic oligonucleotide"

SEQ ID NO: 11090 - DNA, 81 bp, Artificial Sequence; identical to SEQ ID NO: 11058
  source: /note="Description of Artificial Sequence: Synthetic oligonucleotide"

SEQ ID NO: 11091 - DNA, 79 bp, Artificial Sequence; identical to SEQ ID NO: 11084
  source: /note="Description of Artificial Sequence: Synthetic oligonucleotide"

SEQ ID NO: 11092 - DNA, 66 bp, Artificial Sequence; identical to SEQ ID NO: 11063
  source: /note="Description of Artificial Sequence: Synthetic oligonucleotide"

SEQ ID NO: 11093 - DNA, 56 bp, Artificial Sequence; identical to SEQ ID NO: 11061
  source: /note="Description of Artificial Sequence: Synthetic oligonucleotide"

SEQ ID NO: 11094 - DNA, 68 bp, Artificial Sequence; identical to SEQ ID NO: 11062
  source: /note="Description of Artificial Sequence: Synthetic oligonucleotide"

SEQ ID NO: 11095 - DNA, 81 bp, Artificial Sequence; identical to SEQ ID NO: 10925
  source: /note="Description of Artificial Sequence: Synthetic oligonucleotide"

SEQ ID NO: 11096 - DNA, 68 bp, Artificial Sequence; identical to SEQ ID NO: 10926
  source: /note="Description of Artificial Sequence: Synthetic oligonucleotide"

SEQ ID NO: 11097 - DNA, 79 bp, Artificial Sequence; identical to SEQ ID NO: 10928
  source: /note="Description of Artificial Sequence: Synthetic oligonucleotide"

SEQ ID NO: 11098 - DNA, 79 bp, Artificial Sequence; identical to SEQ ID NO: 10927
  source: /note="Description of Artificial Sequence: Synthetic oligonucleotide"

SEQ ID NO: 11099 - DNA, 66 bp, Artificial Sequence
  source: /note="Description of Artificial Sequence: Synthetic oligonucleotide"
aactgcgaccagttcagcaggctgttgtgatgaagagaccagggaggcttatgccaatatcggtga

SEQ ID NO: 11100 - DNA, 78 bp, Artificial Sequence
  source: /note="Description of Artificial Sequence: Synthetic oligonucleotide"
aactgcgaccagttcagcaggctgttgtgtgacggaaggtgatgaagagaccagggaggcttatgccaatatcggtga

SEQ ID NO: 11101 - DNA, 65 bp, Artificial Sequence
  source: /note="Description of Artificial Sequence: Synthetic oligonucleotide"
aactgcgaccagttcagcaggctgttgtgtgaagagaccagggaggcttatgccaatatcggtga

SEQ ID NO: 11102 - DNA, 78 bp, Artificial Sequence; identical to SEQ ID NO: 10929
  source: /note="Description of Artificial Sequence: Synthetic oligonucleotide"

SEQ ID NO: 11103 - DNA, 75 bp, Artificial Sequence
  source: /note="Description of Artificial Sequence: Synthetic oligonucleotide"
aactgcgaccagttcagcaggctgttgtgtggaaggtgatgaagagaccagggaggcttatgccaatatcggtga

SEQ ID NO: 11104 - DNA, 60 bp, Artificial Sequence
  source: /note="Description of Artificial Sequence: Synthetic oligonucleotide"
aactgcgaccagttcagcaggtgatgaagagaccagggaggcttatgccaatatcggtga

SEQ ID NO: 11105 - DNA, 81 bp, Artificial Sequence; identical to SEQ ID NO: 10925
  source: /note="Description of Artificial Sequence: Synthetic oligonucleotide"

SEQ ID NO: 11106 - DNA, 68 bp, Artificial Sequence; identical to SEQ ID NO: 10926
  source: /note="Description of Artificial Sequence: Synthetic oligonucleotide"

SEQ ID NO: 11107 - DNA, 79 bp, Artificial Sequence; identical to SEQ ID NO: 10928
  source: /note="Description of Artificial Sequence: Synthetic oligonucleotide"

SEQ ID NO: 11108 - DNA, 79 bp, Artificial Sequence; identical to SEQ ID NO: 10927
  source: /note="Description of Artificial Sequence: Synthetic oligonucleotide"

SEQ ID NO: 11109 - DNA, 66 bp, Artificial Sequence; identical to SEQ ID NO: 11099
  source: /note="Description of Artificial Sequence: Synthetic oligonucleotide"

SEQ ID NO: 11110 - DNA, 65 bp, Artificial Sequence; identical to SEQ ID NO: 11101
  source: /note="Description of Artificial Sequence: Synthetic oligonucleotide"

SEQ ID NO: 11111 - DNA, 78 bp, Artificial Sequence; identical to SEQ ID NO: 11100
  source: /note="Description of Artificial Sequence: Synthetic oligonucleotide"

SEQ ID NO: 11112 - DNA, 36 bp, Artificial Sequence
  source: /note="Description of Artificial Sequence: Synthetic oligonucleotide"
aactgcgaccagggaggcttatgccaatatcggtga

SEQ ID NO: 11113 - DNA, 75 bp, Artificial Sequence; identical to SEQ ID NO: 11103
  source: /note="Description of Artificial Sequence: Synthetic oligonucleotide"

SEQ ID NO: 11114 - DNA, 78 bp, Artificial Sequence; identical to SEQ ID NO: 10929
  source: /note="Description of Artificial Sequence: Synthetic oligonucleotide"

SEQ ID NO: 11115 - DNA, 81 bp, Artificial Sequence; identical to SEQ ID NO: 10925
  source: /note="Description of Artificial Sequence: Synthetic oligonucleotide"

SEQ ID NO: 11116 - DNA, 68 bp, Artificial Sequence; identical to SEQ ID NO: 10926
  source: /note="Description of Artificial Sequence: Synthetic oligonucleotide"

SEQ ID NO: 11117 - DNA, 79 bp, Artificial Sequence; identical to SEQ ID NO: 10928
  source: /note="Description of Artificial Sequence: Synthetic oligonucleotide"

SEQ ID NO: 11118 - DNA, 79 bp, Artificial Sequence; identical to SEQ ID NO: 10927
  source: /note="Description of Artificial Sequence: Synthetic oligonucleotide"

SEQ ID NO: 11119 - DNA, 66 bp, Artificial Sequence; identical to SEQ ID NO: 11099
  source: /note="Description of Artificial Sequence: Synthetic oligonucleotide"

SEQ ID NO: 11120 - DNA, 78 bp, Artificial Sequence; identical to SEQ ID NO: 11100
  source: /note="Description of Artificial Sequence: Synthetic oligonucleotide"

SEQ ID NO: 11121 - DNA, 65 bp, Artificial Sequence; identical to SEQ ID NO: 11101
  source: /note="Description of Artificial Sequence: Synthetic oligonucleotide"

SEQ ID NO: 11122 - DNA, 78 bp, Artificial Sequence; identical to SEQ ID NO: 10929
  source: /note="Description of Artificial Sequence: Synthetic oligonucleotide"

SEQ ID NO: 11123 - DNA, 44 bp, Artificial Sequence
  source: /note="Description of Artificial Sequence: Synthetic oligonucleotide"
aactgcgaccagttcagcagggaggcttatgccaatatcggtga

SEQ ID NO: 11124 - DNA, 36 bp, Artificial Sequence; identical to SEQ ID NO: 11112
  source: /note="Description of Artificial Sequence: Synthetic oligonucleotide"

SEQ ID NO: 11125 - DNA, 81 bp, Artificial Sequence; identical to SEQ ID NO: 10925
  source: /note="Description of Artificial Sequence: Synthetic oligonucleotide"

SEQ ID NO: 11126 - DNA, 68 bp, Artificial Sequence; identical to SEQ ID NO: 10926
  source: /note="Description of Artificial Sequence: Synthetic oligonucleotide"

SEQ ID NO: 11127 - DNA, 79 bp, Artificial Sequence; identical to SEQ ID NO: 10928
  source: /note="Description of Artificial Sequence: Synthetic oligonucleotide"

SEQ ID NO: 11128 - DNA, 79 bp, Artificial Sequence; identical to SEQ ID NO: 10927
  source: /note="Description of Artificial Sequence: Synthetic oligonucleotide"

SEQ ID NO: 11129 - DNA, 78 bp, Artificial Sequence; identical to SEQ ID NO: 11100
  source: /note="Description of Artificial Sequence: Synthetic oligonucleotide"

SEQ ID NO: 11130 - DNA, 66 bp, Artificial Sequence; identical to SEQ ID NO: 11099
  source: /note="Description of Artificial Sequence: Synthetic oligonucleotide"

SEQ ID NO: 11131 - DNA, 78 bp, Artificial Sequence; identical to SEQ ID NO: 10929
  source: /note="Description of Artificial Sequence: Synthetic oligonucleotide"

SEQ ID NO: 11132 - DNA, 76 bp, Artificial Sequence
  source: /note="Description of Artificial Sequence: Synthetic oligonucleotide"
aactgcgaccagttcagcaggctgttgtgtgggaaggtgatgaagagaccagggaggcttatgccaatatcggtga

SEQ ID NO: 11133 - DNA, 65 bp, Artificial Sequence; identical to SEQ ID NO: 11101
  source: /note="Description of Artificial Sequence: Synthetic oligonucleotide"

SEQ ID NO: 11134 - DNA, 74 bp, Artificial Sequence
  source: /note="Description of Artificial Sequence: Synthetic oligonucleotide"
aactgcgaccagttcagcaggctgttgtgtgaaggtgatgaagagaccagggaggcttatgccaatatcggtga

SEQ ID NO: 11135 - DNA, 61 bp, Artificial Sequence
  source: /note="Description of Artificial Sequence: Synthetic oligonucleotide"
cccctccccgctgggcccccgacttcaccggtgtagtgcaccacgcaggtctggccgcgct

SEQ ID NO: 11136 - DNA, 59 bp, Artificial Sequence
  source: /note="Description of Artificial Sequence: Synthetic oligonucleotide"
cccctccccgctgggcccccgatcaccggtgtagtgcaccacgcaggtctggccgcgct

SEQ ID NO: 11137 - DNA, 58 bp, Artificial Sequence
  source: /note="Description of Artificial Sequence: Synthetic oligonucleotide"
cccctccccgctgggcccccgacaccggtgtagtgcaccacgcaggtctggccgcgct

SEQ ID NO: 11138 - DNA, 58 bp, Artificial Sequence
  source: /note="Description of Artificial Sequence: Synthetic oligonucleotide"
cccctccccgctgggcccccgtcaccggtgtagtgcaccacgcaggtctggccgcgct

SEQ ID NO: 11139 - DNA, 41 bp, Artificial Sequence
  source: /note="Description of Artificial Sequence: Synthetic oligonucleotide"
cccctccccggtgtagtgcaccacgcaggtctggccgcgct

SEQ ID NO: 11140 - DNA, 61 bp, Artificial Sequence
  source: /note="Description of Artificial Sequence: Synthetic oligonucleotide"
ctgggcccccgactcaccggtgtagtgcaccacgcaaggtctggccgcgcttggggaaggt

SEQ ID NO: 11141 - DNA, 57 bp, Artificial Sequence
  source: /note="Description of Artificial Sequence: Synthetic oligonucleotide"
ctgggcccccgactcaccggtgtagtgcaccacgcactggccgcgcttggggaaggt

SEQ ID NO: 11142 - DNA, 56 bp, Artificial Sequence
  source: /note="Description of Artificial Sequence: Synthetic oligonucleotide"
ctgggcccccgactcaccggtgtagtgcaccacgcatggccgcgcttggggaaggt

SEQ ID NO: 11143 - DNA, 58 bp, Artificial Sequence
  source: /note="Description of Artificial Sequence: Synthetic oligonucleotide"
ctgggcccccgactcaccggtgtagtgcaccacgcatctggccgcgcttggggaaggt

SEQ ID NO: 11144 - DNA, 46 bp, Artificial Sequence
  source: /note="Description of Artificial Sequence: Synthetic oligonucleotide"
ctgggcccccgactcaccggtgtagtgcaccacgcttggggaaggt

SEQ ID NO: 11145 - DNA, 59 bp, Artificial Sequence
  source: /note="Description of Artificial Sequence: Synthetic oligonucleotide"
caggtctggccgcgcttggggaaggtgcgccctgagagacagagacgggcatgctgagc

SEQ ID NO: 11146 - DNA, 61 bp, Artificial Sequence
  source: /note="Description of Artificial Sequence: Synthetic oligonucleotide"
caggtctggccgcgcttggggaaggtgcgccctgagggagacagagacgggcatgctgagc

SEQ ID NO: 11147 - DNA, 57 bp, Artificial Sequence
  source: /note="Description of Artificial Sequence: Synthetic oligonucleotide"
caggtctggccgcgcttggggaaggtgcgccctgagacagagacgggcatgctgagc

SEQ ID NO: 11148 - DNA, 59 bp, Artificial Sequence
  source: /note="Description of Artificial Sequence: Synthetic oligonucleotide"
caggtctggccgcgcttggggaaggtgcgccctgggagacagagacgggcatgctgagc

SEQ ID NO: 11149 - DNA, 55 bp, Artificial Sequence
  source: /note="Description of Artificial Sequence: Synthetic oligonucleotide"
caggtctggccgcgcttggggaaggtgcgccctgacagagacgggcatgctgagc

SEQ ID NO: 11150 - DNA, 59 bp, Artificial Sequence
  source: /note="Description of Artificial Sequence: Synthetic oligonucleotide"
gagccgccgcgcgccactactcaccgtctcctgggagatggtttccacctgcactccca

SEQ ID NO: 11151 - DNA, 57 bp, Artificial Sequence
  source: /note="Description of Artificial Sequence: Synthetic oligonucleotide"
gagccgccgcgcgccactactcaccgtctcctgggatggtttccacctgcactccca

SEQ ID NO: 11152 - DNA, 58 bp, Artificial Sequence
  source: /note="Description of Artificial Sequence: Synthetic oligonucleotide"
gagccgccgcgcgccactactcaccgtctcctggagatggtttccacctgcactccca

SEQ ID NO: 11153 - DNA, 35 bp, Artificial Sequence
  source: /note="Description of Artificial Sequence: Synthetic oligonucleotide"
gagccgccgcgcgccactactcacctgcactccca

SEQ ID NO: 11154 - DNA, 41 bp, Artificial Sequence
  source: /note="Description of Artificial Sequence: Synthetic oligonucleotide"
gagccgccgcgcgccactactcaccgtctcctgcactccca

SEQ ID NO: 11155 - DNA, 59 bp, Artificial Sequence
  source: /note="Description of Artificial Sequence: Synthetic oligonucleotide"
gggagatggtttccacctgcactccatggcggcggcggacgctgagcgggcgggcggcg

SEQ ID NO: 11156 - DNA, 58 bp, Artificial Sequence
  source: /note="Description of Artificial Sequence: Synthetic oligonucleotide"
gggagatggtttccacctgcactcatggcggcggcggacgctgagcgggcgggcggcg

SEQ ID NO: 11157 - DNA, 60 bp, Artificial Sequence
  source: /note="Description of Artificial Sequence: Synthetic oligonucleotide"
gggagatggtttccacctgcacttccatggcggcggcggacgctgagcgggcgggcggcg

SEQ ID NO: 11158 - DNA, 58 bp, Artificial Sequence
  source: /note="Description of Artificial Sequence: Synthetic oligonucleotide"
gggagatggtttccacctgcacccatggcggcggcggacgctgagcgggcgggcggcg

SEQ ID NO: 11159 - DNA, 57 bp, Artificial Sequence
  source: /note="Description of Artificial Sequence: Synthetic oligonucleotide"
gggagatggtttccacctgcaccatggcggcggcggacgctgagcgggcgggcggcg

The invention claimed is:

1. A gRNA molecule comprising a tracr and a crRNA, wherein the crRNA comprises a targeting domain that is complementary to a target sequence of B2M, wherein the targeting domain comprises at least 19 consecutive nucleotides of a sequence selected from SEQ ID NO: 5498, SEQ ID NO: 5496, SEQ ID NO: 5499, or SEQ ID NO: 5509.

2. The gRNA molecule of claim 1, wherein the targeting domain comprises SEQ ID NO: 5498, SEQ ID NO: 5496, SEQ ID NO: 5499, or SEQ ID NO: 5509.

3. The gRNA molecule of claim 1, wherein the gRNA molecule comprises SEQ ID NO: 7858 or SEQ ID NO: 7853.

4. The gRNA molecule of claim 1, wherein the targeting domain comprises SEQ ID NO: 5498.

5. The gRNA molecule of claim 1, wherein the targeting domain and the tracr are disposed on separate nucleic acid molecules, and wherein the nucleic acid molecule comprising the targeting domain comprises SEQ ID NO: 6607, disposed immediately 3' to the targeting domain, and wherein the nucleic acid molecule comprising the tracr comprises SEQ ID NO: 6660.

6. The gRNA molecule of claim 1, wherein the gRNA molecule comprises one or more nucleic acid molecules comprising:
   a) one or more phosphorothioate modification(s) at the 3' end of said nucleic acid molecule or molecules;
   b) one or more phosphorothioate modification(s) at the 5' end of said nucleic acid molecule or molecules;
   c) one or more 2'-O-methyl modification(s) at the 3' end of said nucleic acid molecule or molecules;
   d) one or more 2'-O-methyl modification(s) at the 5' end of said nucleic acid molecule or molecules;
   e) one or more 2' O-methyl modification at each of the 4th-to-terminal, 3rd-to-terminal, and 2nd-to-terminal 3' residues of said nucleic acid molecule or molecules; or
   f) any combination thereof.

7. A nucleic acid comprising a sequence that encodes the gRNA molecule of claim 1.

8. A vector comprising the nucleic acid of claim 7.

9. The vector of claim 8, wherein the vector is selected from the group consisting of a lentiviral vector, an adenoviral vector, an adeno-associated viral (AAV) vector, a herpes simplex virus (HSV) vector, a plasmid, a minicircle, a nanoplasmid, and an RNA vector.

10. A composition comprising: (i) a gRNA molecule of claim 1 or nucleic acid comprising a sequence that encodes the gRNA molecule of claim 1; and (ii) a Cas9 molecule or a nucleic acid encoding a Cas9 molecule.

11. The composition of claim 10, wherein the Cas9 molecule comprises any one of SEQ ID NO: 6611 or SEQ ID NO: 7821 to SEQ ID NO: 7831, or a sequence having at least 95% homology thereto.

12. The composition of claim 10, wherein the gRNA molecule and Cas9 molecule are present in a ribonuclear protein complex (RNP).

13. The composition of claim 10, further comprising a second gRNA molecule; a second gRNA molecule and a third gRNA molecule; or a second gRNA molecule, a third gRNA molecule, and a fourth gRNA molecule, wherein the second gRNA molecule, third gRNA molecule, and fourth gRNA molecule are each complementary to a different target sequence.

14. A composition comprising:
   a) a first gRNA molecule comprising the gRNA molecule of claim 1; and
   b) a second gRNA molecule comprising a tracr and a crRNA, wherein the crRNA of said second gRNA molecule comprises a targeting domain selected from any one of SEQ ID NO: 5528 to SEQ ID NO: 5623, SEQ ID NO: 5816 to SEQ ID NO: 5965, SEQ ID NO: 5624 to SEQ ID NO: 5643, SEQ ID NO: 5966 to SEQ ID NO: 6097, SEQ ID NO: 5644 to SEQ ID NO: 5719, SEQ ID NO: 6098 to SEQ ID NO: 6226, SEQ ID NO: 84 to SEQ ID NO: 392, SEQ ID NO: 393 to SEQ ID NO: 532, SEQ ID NO: 10780 to SEQ ID NO: 10794, SEQ ID NO: 533 to SEQ ID NO: 839, SEQ ID NO: 10677 to SEQ ID NO: 10764, SEQ ID NO: 840 to SEQ ID NO: 968, and SEQ ID NO: 10765 to SEQ ID NO: 10779.

15. The composition of claim 14, wherein the targeting domain of said second gRNA molecule is selected from any one of SEQ ID NO: 5624 to SEQ ID NO: 5643 and SEQ ID NO: 5966 to SEQ ID NO: 6097.

16. The composition of claim 14, further comprising a third gRNA molecule comprising a tracr and a crRNA, wherein the crRNA of said third gRNA molecule comprises a targeting domain selected from any one of SEQ ID NO: 6325 to SEQ ID NO: 6583, SEQ ID NO: 6662 to SEQ ID NO: 6749, SEQ ID NO: 6750 to SEQ ID NO: 7716, SEQ ID NO: 7717 to SEQ ID NO: 7804, and SEQ ID NO: 8622 to SEQ ID NO: 10089.

17. The composition of claim 16, wherein the targeting domain of said third gRNA molecule is selected from any one of SEQ ID NO: 6750 to SEQ ID NO: 7716 and SEQ ID NO: 7717 to SEQ ID NO: 7804.

18. The composition of claim 16, further comprising a fourth gRNA molecule comprising a tracr and a crRNA, wherein the crRNA of said fourth gRNA molecule comprises a targeting domain that is complementary to a target sequence of a target of an NK inhibitory molecule.

19. The composition of claim 18, wherein the target of an NK inhibitory molecule is LILRB1.

20. The composition of claim 18, wherein the targeting domain of said fourth gRNA molecule consists of:
    a) any one of SEQ ID NO: 10090 to SEQ ID NO: 10673;
    b) 17, 18, 19, 20, 21, 22, 23, or 24 consecutive nucleotides of any one of SEQ ID NO: 10090 to SEQ ID NO: 10673;
    c) the 5' 17, 18, 19, 20, 21, 22, 23 or 24 nucleotides, preferably 20 nucleotides, of any one of SEQ ID NO: 10090 to SEQ ID NO: 10673; or
    d) the 3' 17, 18, 19, 20, 21, 22, 23 or 24 nucleotides, preferably 20 nucleotides, of any one of SEQ ID NO: 10090 to SEQ ID NO: 10673.

21. The composition of claim 10, formulated in a medium suitable for electroporation.

22. The composition of claim 10, further comprising a template nucleic acid.

23. The composition of claim 22, wherein the template nucleic acid is in a vector.

24. The composition of claim 22, wherein the template nucleic acid comprises a nucleic acid encoding a chimeric antigen receptor (CAR).

25. The composition of claim 24, wherein the CAR is:
    (a) a CD19 CAR;
    (b) a BCMA CAR;
    (c) a CD20 CAR;
    (d) a CD22 CAR;
    (e) a CD123 CAR;
    (f) an EGFRvIII CAR; or
    (g) a mesothelin CAR.

26. The composition of claim 22, wherein the template nucleic acid comprises a nucleic acid encoding an NK inhibitory molecule.

27. A method of altering a target sequence of a cell, comprising contacting said cell with:
    a) a gRNA molecule of claim 1, and a Cas9 molecule;
    b) a gRNA molecule of claim 1, and a nucleic acid encoding a Cas9 molecule;
    c) a nucleic acid encoding a gRNA molecule of claim 1 and a Cas9 molecule;
    d) a nucleic acid encoding a gRNA molecule of claim 1, and a nucleic acid encoding a Cas9 molecule;
    e) any of a) to d), above, and a template nucleic acid; or
    f) any of a) to d) above, and a nucleic acid comprising sequence encoding a template nucleic acid; and
    (g) any one of a) to f), above, and one or more additional gRNA molecules.

28. The method of claim 27, wherein the gRNA molecule or the nucleic acid encoding the gRNA molecule, and the Cas9 molecule or the nucleic acid encoding the Cas9 molecule, are formulated in more than one composition.

29. The method of claim 27, wherein the gRNA molecule or the nucleic acid encoding the gRNA molecule, the Cas9 molecule or the nucleic acid encoding the Cas9 molecule, and, if present, the one or more additional gRNA molecule(s) and template nucleic acid are introduced into the cell by electroporation.

30. The method of claim 27, wherein the cell is a mammalian, primate, or human cell.

31. The method of claim 27, wherein the cell is an immune effector cell.

32. The method of claim 31, wherein the immune effector cell is a T cell or NK cell.

33. The method of claim 31, wherein the immune effector cell is a T cell, wherein the T cell is a CD4+ T cell, a CD8+ T cell, or a combination thereof.

34. The method of claim 27, wherein the cell is autologous or allogeneic with respect to a patient to be administered said cell.

35. The method of claim 27, wherein contacting the cell comprises introducing a nucleic acid sequence encoding a chimeric antigen receptor (CAR).

36. The method of claim 35, wherein the nucleic acid sequence encoding the CAR is in a vector.

37. The method of claim 35, wherein the CAR is:
    (a) a CD19 CAR;
    (b) a BCMA CAR;
    (c) a CD20 CAR;
    (d) a CD22 CAR;
    (e) a CD123 CAR;
    (f) an EGFRvIII CAR; or
    (g) a mesothelin CAR.

38. The method of claim 37, wherein:
    (a) the CAR is a CD19 CAR comprising an antigen binding domain comprising any one of SEQ ID NO: 7883 to SEQ ID NO: 7898;
    (b) the CAR is a CD19 CAR and comprises any one of SEQ ID NO: 7908 to SEQ ID NO: 7920;
    (c) the CAR is a BCMA CAR comprising an antigen binding domain comprising any one of SEQ ID NO: 7939 to SEQ ID NO: 8112;
    (d) the CAR is a BCMA CAR and comprises any one of SEQ ID NO: 8549 to SEQ ID NO: 8621; or
    (e) the CAR is a CD123 CAR and comprises any one of SEQ ID NO: 7812-7818.

39. A cell, altered by the method of claim 27.

40. A cell, comprising the gRNA molecule of claim 1 or an indel at or near a target sequence that is complementary to the targeting domain of the gRNA molecule of claim 1.

41. The cell of claim 40, wherein the gRNA molecule comprises SEQ ID NO: 7858 or SEQ ID NO: 7853.

42. The cell of claim 40, wherein the cell comprises a nucleic acid sequence encoding a chimeric antigen receptor (CAR).

43. The cell of claim 40, wherein the cell comprises a second gRNA molecule, or a nucleic acid encoding a second gRNA molecule, or an indel at or near a target sequence that is complementary to the targeting domain of a second gRNA molecule, wherein the first gRNA molecule and second gRNA molecule comprise nonidentical targeting domains.

44. The cell of claim 43, wherein the second gRNA molecule comprises a targeting domain complementary with a target sequence of an inhibitory molecule or downstream effector of signaling through an inhibitory molecule, wherein the inhibitory molecule or downstream effector of signaling through an inhibitory molecule is CD274, HAVCR2, LAG3, PDCD1, PD-L2, CTLA4, CEACAM, VISTA, BTLA, TIGIT, LAIR1, CD160, 2B4, CD80, CD86, B7-H3 (CD113), B7-H4 (VTCN1), HVEM (TNFRSF14 or CD107), KIR, A2aR, MHC class I, MHC class II, GAL9, adenosine, TGF beta, or PTPN11.

45. The cell of claim 43, wherein the second gRNA molecule is selected from:
   (a) a gRNA molecule that comprises a targeting domain complementary to a target sequence of NLRC5; and
   (b) a gRNA molecule that comprises a targeting domain complementary to a target sequence of B2M, HLA-A, HLA-B or HLA-C.

46. The cell of claim 43, wherein the cell further comprises a third gRNA molecule, or a nucleic acid encoding a third gRNA molecule, wherein the first gRNA molecule, the second gRNA molecule and the third gRNA molecule comprise nonidentical targeting domains.

47. The cell of claim 46, wherein the third gRNA molecule comprises a targeting domain complementary to a target sequence of CIITA, RFXANK, RFX5, or RFXAP.

48. The cell of claim 47, wherein the third gRNA molecule comprises a targeting domain complementary to a target sequence of CIITA comprising any one of SEQ ID NO: 7717 to SEQ ID NO: 7804, SEQ ID NO: 7769, SEQ ID NO: 7771, or SEQ ID NO: 7785.

49. The cell of claim 43, wherein:
   (1) the second guide RNA molecule comprises a targeting domain selected from the group consisting of SEQ ID NO: 1 to SEQ ID NO: 83 and SEQ ID NO: 5492 to SEQ ID NO: 5527;
   (2) the second guide RNA molecule comprises a targeting domain selected from the group consisting of SEQ ID NO: 969 to SEQ ID NO: 1345;
   (3) the second guide RNA molecule comprises a targeting domain selected from the group consisting of SEQ ID NO: 1346 to SEQ ID NO: 1698;
   (4) the second guide RNA molecule comprises a targeting domain selected from the group consisting of SEQ ID NO: 1699 to SEQ ID NO: 2068;
   (5) the second guide RNA molecule comprises a targeting domain selected from the group consisting of SEQ ID NO: 2069 to SEQ ID NO: 2941;
   (6) the second guide RNA molecule comprises a targeting domain selected from the group consisting of SEQ ID NO: 5278 to SEQ ID NO: 5491;
   (7) the second guide RNA molecule comprises a targeting domain selected from the group consisting of SEQ ID NO: 6227 to SEQ ID NO: 6324; and
   (8) the second guide RNA molecule comprises a targeting domain selected from the group consisting of SEQ ID NO: 6325 to SEQ ID NO: 6583.

50. The cell of claim 43, wherein:
   (1) the second guide RNA molecule comprises a targeting domain selected from the group consisting of SEQ ID NO: 2942 to SEQ ID NO: 3270;
   (2) the second guide RNA molecule comprises a targeting domain selected from the group consisting of SEQ ID NO: 3271 to SEQ ID NO: 3541;
   (3) the second guide RNA molecule comprises a targeting domain selected from the group consisting of SEQ ID NO: 3542 to SEQ ID NO: 4032;
   (4) the second guide RNA molecule comprises a targeting domain selected from the group consisting of SEQ ID NO: 4033 to SEQ ID NO: 4589 and SEQ ID NO: 5720 to SEQ ID NO: 5815; and
   (5) the second guide RNA molecule comprises a targeting domain selected from the group consisting of SEQ ID NO: 4590 to SEQ ID NO: 5277.

51. A population of cells, wherein at least about 30% of the population is a cell of claim 40.

52. A method of preparing cells for immunotherapy comprising: (a) modifying cells by reducing or eliminating expression of a component of a T-cell receptor (TCR) comprising introducing into said cells a gRNA molecule comprising a targeting domain which comprises any one of SEQ ID NO: 5528 to SEQ ID NO: 5623 or SEQ ID NO: 5816 to SEQ ID NO: 5965; (b) modifying cells by reducing or eliminating expression of B2M comprising introducing into said cells a gRNA molecule of claim 1; and (c) expanding said cells.

53. The method of claim 52, further comprising modifying said cells by reducing or eliminating expression of CIITA comprising introducing into said cells a gRNA molecule comprising a targeting domain which comprises any one of SEQ ID NO: 6750 to SEQ ID NO: 7716 or SEQ ID NO: 7717 to SEQ ID NO: 7804, wherein said modifying takes place before the step of expanding said cells.

54. The gRNA molecule of claim 1, wherein the targeting domain and the tracr are disposed on a single nucleic acid molecule.

55. The gRNA molecule of claim 54, wherein the single nucleic acid molecule is an sgRNA molecule.

* * * * *